United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 7

SEQ ID NO: 6442 - DNA, 2991 bp, Homo sapiens
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggc

SEQ ID NO: 6443 - DNA, 2937 bp, Homo sapiens
atatcctcccctgggctgaaggcactcttgtcctccaagcctcccctacagcagtgttcatgggcagctggagcagggctgcctacccattgctactcccaggagctcaggactggctccagacccctggcatctggagcagaagcaacatcaaagcagggattggccaactcccacccctaatgccaaacaggccaggcactgggagcactcagaggcgtgacgaatctcagcctgtctccggctagtgttccctggccagtccgctttgggccctgcctcacaatgacgggctcatcattcagcctcgctcatctgctcatcatttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgg

SEQ ID NO: 6444 - DNA, 582 bp, Homo sapiens
atttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccacca

SEQ ID NO: 6445 - DNA, 2849 bp, Homo sapiens
atgacgggctcatcattcagcctcgctcatctgctcatcatttcaggactgctctgttactcggcaggctgcttggcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagtgcaatcctctcttgcttctctttccttctttccagggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttcccca

SEQ ID NO: 6446 - DNA, 3146 bp, Homo sapiens
gcaccgaggcgcggagcgcggcgcacggcggtgcccagggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggcggcatgttcgccgcggtggagggcgcctacgagaacaagaccatcgacttcgacgcctacagtgtgggccgccgcggctcggcgcgcacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttca

SEQ ID NO: 6447 - DNA, 2911 bp, Homo sapiens
ccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 6448 - DNA, 2764 bp, Homo sapiens
ctggtacggggaacctaggacttaacaactccaaggaagggagtgtaggagttggggagggacagtgtccccatctgcaatttccggtcattgacagggattttaggccccgctgagagccagggatgcatgaatgcgtggagggaaatgagttgtaaacagagtgtaggggaacctggcatctccatgctgctttgctgcagctaatatgttttgcacccggggtacatcattttacctctgtaagcctcaatttcctgtctgtaaaatgggaaaattatgcctagtgttcctgggatactgagctggcttctctgtgaagctaaaacctcacctctattttaaggcccaggtgtctctggcctcctgccctggattaggggactggcccctggggtggtgaaggtcagggccccagcccccaaccacagtgctgggggagctgtaccaagcctaggccaccctcgctctggatggcaacttgaaagcagaaaagatgagtagtttcataggacctgtggggttggatttcgcatgcagaaaatgaacaacgaagtggtggacaagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccac

SEQ ID NO: 6449 - DNA, 2795 bp, Homo sapiens
agccggggcagccgcgcgtgggcatccacgggcgccgagcctccgtccgtgtctctatccctcccggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactg

SEQ ID NO: 6450 - DNA, 1266 bp, Homo sapiens
tttggcatttctgggagacccttttctgaggaaccacagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcagggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgctcggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcatgctcttttgtgatgattttcatattttcacacatggtatattattgacccaataactcgccaggttacatgggtcttgagagagaattttaattactaattgtgcacgagatagttggttgtctatatgtcaaatgagttgttctcttggtatttgctctaccatctctccctagagcactctgtgtctatcccagtggataatttcccagtttactggtgatgattaggaaggttgttgatgg

SEQ ID NO: 6451 - DNA, 1381 bp, Homo sapiens
cttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaagcagtcacagccagtcgtgacagcttctgacatctccaaaaggaagtgcacctcgtcctttgtagaaatgggatcacagggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaa

SEQ ID NO: 6452 - DNA, 1259 bp, Homo sapiens
gccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagtagttaagtccaaa

SEQ ID NO: 6453 - DNA, 1311 bp, Homo sapiens
ggacggtggacgcagcgcagacaggaagctccccgagataacgctgcggccgggcggcctgatttgctgggctgtctgatggcccgggccgaggcttctccctgcgcctgggactgcggccgcctctctaaatagcagccatgaggcgcctgggggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagt

SEQ ID NO: 6454 - DNA, 1303 bp, Homo sapiens
agatttgggagaaggatttcaaatgacttcccttcgagctgcagggctatcttgggcatcttgacctccacacatttctgggagaactcctcgtgcagcaggacatcaggtggcaaaggtgatctgcccacctcagcctcccaaagtgctggaattacaggtgtgagccactgcgcctggtcttgttttccaagttgtaacgcccttcacgatgaagaaacaaagaggagttggtgtcctgcctgcgctcaggatgagggggaatctggccctggtgggcgttctaatcagcctggccttcctgtcactgctgccatctggacatcctcagccggctggcgatgacgcctgctctgtgcagatcctcgtccctggcctcaaaggggatgcgggagagaagggagacaaaggcgcccccggacggcctggaagagtcggccccacgggagaaaaaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccc

SEQ ID NO: 6455 - DNA, 1134 bp, Homo sapiens
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggagacatgggggacaaaggacagaaaggcagtgtgggtcgtcatggaaaaattggtcccattggctctaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 6456 - DNA, 1134 bp, Homo sapiens
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggggatgcgggagagaagggagacaaaggcgcccccggacggcctggaagagtcggccccacgggagaaaaaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 6457 - DNA, 1062 bp, Homo sapiens
cagaagttttggtgaaagtggctttggccctgactttgtggtagcgtgtgtgggtttgtgagtggaaccttcagctttaggttggaaacggtggctgtggagagctggacttttggctgtggaggtcacgtccctgcccaatgtggtgggtgcctccgagtccctacggttgtcttccctgcgccctgccaggtgagaaaggagattccggtgacataggaccccctggtcctaatggagaaccaggcctcccatgtgagtgcagccagctgcgcaaggccatcggggagatggacaaccaggtctctcagctgaccagcgagctcaagttcatcaagaatgctgtcgccggtgtgcgcgagacggagagcaagatctacctgctggtgaaggaggagaagcgctacgcggacgcccagctgtcctgccagggccgcgggggcacgctgagcatgcccaaggacgaggctgccaatggcctgatggccgcatacctggcgcaagccggcctggcccgtgtcttcatcggcatcaacgacctggagaaggagggcgccttcgtgtactctgaccactcccccatgcggaccttcaacaagtggcgcagcggtgagcccaacaatgcctacgacgaggaggactgcgtggagatggtggcctcgggcggctggaacgacgtggcctgccacaccaccatgtacttcatgtgtgagtttgacaaggagaacatgtgagcctcaggctggggctgcccattgggggccccacatgtccctgcagggttggcagggacagagcccagaccatggtgccagccagggagctgtccctctgtgaagggtggaggctcactgagtagagggctgttgtctaaactgagaaaatggcctatgcttaagaggaaaatgaaagtgttcctggggtgctgtctctgaagaagcagagtttcattacctgtattgtagccccaatgtcattatgtaattattacccagaattgctcttccataaagcttgtgcctttgtccaagctatacaataaaatctttaagtagtgcagta

SEQ ID NO: 6458 - DNA, 3134 bp, Homo sapiens
agagcggcgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggctccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccagcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtgtatatatata

SEQ ID NO: 6459 - DNA, 3989 bp, Homo sapiens
gaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 6460 - DNA, 2145 bp, Homo sapiens
ggttgccttgcctagctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggcctcaggactataccaatctgccgagcagcagcagaagcggtggcagcggcagcagcagcagtga

SEQ ID NO: 6461 - DNA, 3697 bp, Homo sapiens
ggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcagtca

SEQ ID NO: 6462 - DNA, 921 bp, Homo sapiens
atgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtaggcacaccttcaccctctctctgccccgcctga

SEQ ID NO: 6463 - DNA, 1628 bp, Homo sapiens
agcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttgatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 6464 - DNA, 1410 bp, Homo sapiens
agcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctggg

SEQ ID NO: 6465 - DNA, 1756 bp, Homo sapiens
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 6466 - DNA, 1283 bp, Homo sapiens
ttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccag

SEQ ID NO: 6467 - DNA, 1720 bp, Homo sapiens
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactggtagttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 6468 - DNA, 1601 bp, Homo sapiens
ccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctggg

SEQ ID NO: 6469 - DNA, 2291 bp, Homo sapiens
ggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggcgccgtggctcatgcctgtaatcctaacactttggaggattgctggagacaggagtttaagaccagtctgggcaacatagcaagaccctgtctctacaaaaaaggcaaaaattagctgggcgtggtggcttgtgcctgtagtgccagctatctgggaggctgaggcgggaggatcacttgagttcaagctgacagtaagctatgattgcaccgttgcactccagcctgggtaacaaactaagaccccatctctctgtctcaaaaaaagtgatacttcgcaaagatgcttagactccaagaagcttttgcatctctttccaacccaactactgaggtactgtgtagcctcctccttgaataactaacctggtgagctgagattgcgccattgcaatccagcctgggcaacaagagcaaaactccatcacatttaaaaaaaaaaaaaaa

SEQ ID NO: 6470 - DNA, 1816 bp, Homo sapiens
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctga

SEQ ID NO: 6471 - DNA, 802 bp, Homo sapiens
agaagcgggagtctccgagagaagaaaagcaggtggaaggagaggaagcggatgccgtggggctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaa

SEQ ID NO: 6472 - DNA, 1787 bp, Homo sapiens
ctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttgggtctcactctgtcacccaggctggagtgcaatggcacaatctcggctcactgcaacctccgtctcccaggctcaagcgattctcctgcctcagactcccaggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 6473 - DNA, 856 bp, Homo sapiens
ctccgagagaagaaaagcaggtggaaggagaggaagcggatgccgtggggtttacagcaggaaaatccgtggagacagcagatccgagaagcggcgatgtttgcgtagaaccctgtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccagctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtct

SEQ ID NO: 6474 - DNA, 1981 bp, Homo sapiens
ctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctgtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccagctcttcccttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 6475 - DNA, 1622 bp, Homo sapiens
ctctgaagggagctactcagaagcgggagtctccgagagaagaaaagcaggtggaaggagaggaagcggatgccgtggggctcttcccttctctctgaccagcaccatgcttctcctggtgacaagccttctgctctgtgagttaccacacccagcattcctcctgatcccagagaaatcggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttctgacgacgggaacctcggctctgtgtacatttatgtgctcctaatcgtgggaacccttgtctgtggcatcgtcctcggcttcctctttaaaaggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 6476 - DNA, 4866 bp, Homo sapiens
gcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaa

SEQ ID NO: 6477 - DNA, 4863 bp, Homo sapiens
actctgcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaa

SEQ ID NO: 6478 - DNA, 969 bp, Homo sapiens
ggttcccacctccgggactttgctcctgcagggccttggctggggttctctccctgcttcagccgctagcaccctccttgtgcctgaagcccgcactgggatgctcctgggctcttgagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcc

SEQ ID NO: 6479 - DNA, 2765 bp, Homo sapiens
agaccaaggagagatggcgctagcctgggagttcacagatgggaaaactgaggccctggagggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagac

SEQ ID NO: 6480 - DNA, 4087 bp, Homo sapiens
gcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaac

SEQ ID NO: 6481 - DNA, 2352 bp, Homo sapiens
atggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggctgggcctcccaggcgatctgcatactttaaggaccagatcatgctccatccagccccacccaatggccttttgtgcttgtttcctataacttcagtattgtaa

SEQ ID NO: 6482 - DNA, 2656 bp, Homo sapiens
atggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagcaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtt

SEQ ID NO: 6483 - DNA, 2886 bp, Homo sapiens
ggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgt

SEQ ID NO: 6484 - DNA, 3454 bp, Homo sapiens
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggagctgcccggacccagacagggacagtggctggggcagacatctgaaatgagccgtgctctcaccccacatccttgtgtgcaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 6485 - DNA, 2953 bp, Homo sapiens
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 6486 - DNA, 3373 bp, Homo sapiens
gaaaagaggcttagggccgggtgagccttccagccagggcctgcctccaagtgatgctcccccagggcagggggcataaggatggcacccagccaggtgggagcctgggccctgcccagcctcaaagctttgagctcaggaaatccggaggcaggggagggggacatcgttgccacattccccagccctttaagacccccaaggcaggaaggctgcccgggcctcaccagcttccctcacaggctccttcctgggaggaaggggctgcctgtgccctcgaaggcgcaagggagggcaggagggaggctcggaaggtgttgcaatccccagcccccgggcctgtcagaggctgagccattaacgacagagctcggggagagaagctggactgcagctggtttcaggaacttctcttgacgagaagagagaccaaggaggccaagcaggggctgggccagaggtgccaacatggggaaactgaggctcggctcggaaaggtgaagtaacttgtccaagatcacaaagctggtgaacatcaagttggtgctatggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggtttgcagtttttgttgttgtttatagacactcttgggtgta

SEQ ID NO: 6487 - DNA, 2750 bp, Homo sapiens
atggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtt

SEQ ID NO: 6488 - DNA, 2592 bp, Homo sapiens
atggcaaggctgggaaactgcagcctgacttgggctgccctgatcatcctgctgctccccggaagtctggaggagtgcgggcacatcagtgtctcagcccccatcgtccacctgggggatcccatcacagcctcctgcatcatcaagcagaactgcagccatctggacccggagccacagattctgtggagactgggagcagagcttcagcccgggggcaggcagcagcgtctgtctgatgggacccaggaatctatcatcaccctgccccacctcaaccacactcaggcctttctctcctgctgcctgaactggggcaacagcctgcagatcctggaccaggttgagctgcgcgcaggctaccctccagccataccccacaacctctcctgcctcatgaacctcacaaccagcagcctcatctgccagtgggagccaggacctgagacccacctacccaccagcttcactctgaagagtttcaagagccggggcaactgtcagacccaaggggactccatcctggactgcgtgcccaaggacgggcagagccactgctgcatcccacgcaaacacctgctgttgtaccagaatatgggcatctgggtgcaggcagagaatgcgctggggaccagcatgtccccacaactgtgtcttgatcccatggatgttgtgaaactggagccccccatgctgcggaccatggaccccagccctgaagcggcccctccccaggcaggctgcctacagctgtgctgggagccatggcagccaggcctgcacataaatcagaagtgtgagctgcgccacaagccgcagcgtggagaagccagctgggcactggtgggccccctccccttggaggcccttcagtatgagctctgcgggctcctcccagccacggcctacaccctgcagatacgctgcatccgctggcccctgcctggccactggagcgactggagccccagcctggagctgagaactaccgaacgggcccccactgtcagactggacacatggtggcggcagaggcagctggaccccaggacagtgcagctgttctggaagccagtgcccctggaggaagacagcggacggatccaaggttatgtggtttcttggagaccctcaggccaggctggggccatcctgcccctctgcaacaccacagagctcagctgcaccttccacctgccttcagaagcccaggaggtggcccttgtggcctataactcagccgggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggagaacatcaggccctttcagctctatgagatcatcgtgactcccttgtaccaggacaccatgggaccctcccagcatgtctatgcctactctcaagaaatggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggagctgcccggacccagacagggacagtggctggggcagacatctgaaatgagccgtgctctcaccccacatccttgtgtgcaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctag

SEQ ID NO: 6489 - DNA, 1440 bp, Homo sapiens
ggacctctcgtcccactccggtggtcttctcagaaagcagaggcccagctctgaccagactccatgccatggcccgagaccctcacagcctctgggtaggctgggagccccccaatccatggcctcagggctatgtgattgagtggggcctgggcccccccagcgcgagcaatagcaacaagacctggaggatggaacagaatgggagagccacggggtttctgctgaaggctccctcccatgccccagagctgcatctaaagcacattggcaagacctgggcacagctggagtgggtgcctgagccccctgagctggggaagagcccccttacccactacaccatcttctggaccaacgctcagaaccagtccttctccgccatcctgaatgcctcctcccgtggctttgtcctccatggcctggagcccgccagtctgtatcacatccacctcatggctgccagccaggctggggccaccaacagtacagtcctcaccctgatgaccttgaccccagaggggtcggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggaggaggatgaaaagaagccggtgccctgggagtcccataacagctcagagacctgtggcctccccactctggtccagacctatgtgctccagggggacccaagagcagtttccacccagccccaatcccagtctggcaccagcgatcaggtcctttatgggcagctgctgggcagccccacaagcccagggccagggcactatctccgctgtgactccactcagcccctcttggcgggcctcacccccagccccaagtcctatgagaacctctggttccaggccagccccttggggaccctggtaaccccagccccaagccaggaggacgactgtgtctttgggccactgctcaacttccccctcctgcaggggatccgggtccatgggatggaggcgctggggagcttctagggcttcctggggttcccttcttgggcctgcctcttaaaggcctgagctagctggagaagaggggagggtccataagcccatgactaaaaactaccccagcccaggctctcaccatctccagtcaccagcatctccctctcctcccaatctccataggctgggcctcccaggcgatctgcatactttaaggaccagatcatgctccatccagccccacccaatggccttttgtgcttgtttcctataacttcagtattgtaaactagtttttggt

SEQ ID NO: 6490 - DNA, 512 bp, Homo sapiens
gagagtagaaacagcaagggagcgaggggtgtgaagtggggaagagagtgtgaggggagagggctgagcgtgatgagggagaaacagaaagagggaatgtgaaggcagccagcccaggagacatcgagctgtgctgggccacaggagtgagcacctgcagagcccagcagagatggccgcagtgacaggagggccagggggcccaggagttaggaggagaggatccagaaagggggctttggaactgcgcagtgtggcacagacaaaagcaagatggggaaactgaggctcggctcggaaaggtgaagtaacttgtccaagatcacaaagctgggataaattgaccctccagtggacagctctgagaagtgttctacatggctctttggaaggttccagcaggatagagccccagttgtccatagaggtgaacatcaagttggtgctatggcaaggctgggaaactgcagcctgacttgggctgccctgatcatcctgctgctccccggaag

SEQ ID NO: 6491 - DNA, 1373 bp, Homo sapiens
ggcccgcttttggctgcatcagccggggattgccggcgccaggtgctgggggcgactcggacagcgggagcgtggggtggagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgagg

SEQ ID NO: 6492 - DNA, 1297 bp, Homo sapiens
cggaagtggctctcagggcgcttccggggaccaggcccgcttttggctgcatcagccggggattgccggcgccaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaaaattaactggaata

SEQ ID NO: 6493 - DNA, 1573 bp, Homo sapiens
agttttattgggctataattcacataccatataattcacccattttgtacaattcaatgattttggcatattattttttaactatggtaaagtacatgttaaataaaatggctcggccattgtttcggaccgagctcctgcgctagggcccaacagagcagcccaaagcggaaccgagtcacgcgcgccggacgccacccgacaggaggggaaacggggcagctctcaaaaccctggaggcgcagaccgtccacacgggacagggacgcccgctcggctccgctccgcgctgatcctcaaggtctcgcggtttccccgccgcccacccggacgccgacgaaagccagcgagctcctcagcctcaggcatctgcatctgggaccgacctcctgggctggctgatcaaagaggaagcagcagcaatgtctgctgtgggggctgcaactccatacctgcatcatcctggtgatagtcacagtggccgagtgagtttcttgggggcccagcttcctccagaggtggcagcaatggcccggctactaggggacctagacaggagcacgttcagaaagttgctgaagtttgtggtcagcagcctgcagggggaggactgccgagaggctgtgcagcgtcttggggtcagcgccaacctgccggaggagcagctgggtgccctgctggcaggcatgcacacactgctccagcaggccctccgtctgccccccaccagcctgaagcctgacaccttcagggaccagctccaggagctctgcatcccccaagacctggtcggggacttggccagcgtggtatttgggagccagcggcccctccttgattctgtggcccagcagcagggggcctggctgccgcatgttgctgactttcggtggcgggtggatgtagcaatctccaccagtgccctggctcgctccctgcagccgagcgtcctgatgcagctgaagctttcagatgggtcagcataccgctttgaggtccccacagccaagttccaggagctgcggtacagcgtggccctggtcctaaaggagatggcagatctggagaagaggtgtgagcgcagactgcaggactgacccctcacttgaccagtcccattcagatccggcttggacaggcacctgagatggtgccaaagtgcagctgactcttcccacgacagccctgcccttcccatgaggcaggctcttcagtgagtgtttgaacgtaattatgtagttttctgtttaattgaaaaagagagctatgcctttttttctttttggaagtaaagcagctaaaaacatgtttctataggtgagtgttggacctcacaccctccccttccctgtacatttgtctttggtgctggacgtggccatgtgaggccaggttgaggccctttgtagacaacatacagttgctcagcctggccccatgtagccaggtgcttttgtagatcttgtgttttaggttgggcattttcactcttctgccttaaatccctgaccccatggagctgacattctagtgcggctgaggggaggggaaacattgtaaaataaatcataaa

SEQ ID NO: 6494 - DNA, 486 bp, Homo sapiens
ctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagcctcagctcctggcaacctccagtctcctttctgcttctaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaa

SEQ ID NO: 6495 - DNA, 1793 bp, Homo sapiens
tgatcaccaaattcaaggcggcccttgattagattctagttgtggatgggcttcccctgctacgtccgccccatgcgccaggccgctaggggcaggacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacagtagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaatttaaaccctcttcacaccctgtctgcatttctgcaggtctgtgtgagtccactttcttttttgttccctgctaggtagcacacagctgtgaggagcccaggactgctgcctgccgcagcccacctgtgcgctcagattcctaccagcttgatgagttagctgatgggccatttgtgcataccaactacccacagacatttctattacccaccctctggatgccagtgcattaatgattctagaattaggagaaaccaaagatcccttctctctccctcccacaaccagtgtcgtcgtgttcctagaaataagagtagaaacccctctatctgggttaaaacagcaaacctgccttctgtaactgtgcatgaggttcctctgtctcccacttacttcggattaacaccttcctctttccccttccctgtttgcagggtagcatttctaggtttaaggcaatatgcaaaaagacccaaagttaggccctggctcaaacactgtgggtagcagatttgaaataaatttaaattgca

SEQ ID NO: 6496 - DNA, 1683 bp, Homo sapiens
ggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaacaggaactgggtagtggtgatgaatgcaaaactttgtgaatgtgctttataaaagtgataattagacactttagaggatatacttggtgataatgtgaatgatgtaatcagactaacagttgaatcattgctgttggaggcagcacaaatttatgtgttacaacagtagtttaaaaacttgtactggatggaacccattttataaacagtcttatttggagtcatgtatataaaaatatatataaattagaaaagtagtatttgattaggataactttacaaattcaatagtatagccatcacttattataatggcaatcagaagagtgaggcttcttttttcaaacttttgtaatcagattaagattgaccattgctcctttacacagtattagtctagcattcaattatttctgttattaatggttgtagaaagttcaaatacatacgcagagttggaaagacgagttttagtctgagttctgtacgacggagttaacccgttagcacaagttattgcattagatgatctctgttgaatttaaatacataaacctgttgttaaacgcttttatactataaagccaccacattgtatggcatttgtttagaagtaagcaaatagaccaccggaatagaatagatggcctagaaatagatcaagacattctggtccgccatattagaaatttaaaccctcttcacaccctgtctgcatttctgcaggtctgtgtgagtccactttcttttttgttccctgctaggtagcacacagctgtgaggagcccaggactgctgcctgccgcagcccacctgtgcgctcagattcctaccagcttgatgagttagctgatgggccatttgtgcataccaactacccacagacatttctattacccaccctctggatgccagtgcattaatgattctagaattaggagaaaccaaagatcccttctctctccctcccacaaccagtgtcgtcgtgttcctagaaataagagtagaaacccctctatctgggttaaaacagcaaacctgccttctgtaactgtgcatgaggttcctctgtctcccacttacttcggattaacaccttcctctttccccttccctgtttgcagggtagcatttctaggtttaaggcaatatgcaaaaagacccaaagttaggccctggctcaaacactgtgggtagcagatttgaaataaatttaaattgcatgttt

SEQ ID NO: 6497 - DNA, 7470 bp, Homo sapiens
atgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttga

SEQ ID NO: 6498 - DNA, 7469 bp, Homo sapiens
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 6499 - DNA, 7469 bp, Homo sapiens
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 6500 - DNA, 7469 bp, Homo sapiens
acactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggattaccagtagatgggactacaggcacctgccaacacgcccggctaatttttttgtatttttagtagagacggggtttcaccatgttagccaggatggtctggatctcctgacctcgtgatccacctgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataa

SEQ ID NO: 6501 - DNA, 6959 bp, Homo sapiens
cttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtcaatgcaatgccccagaatggcttccatttgccaggcctaccaacctaactgatgaatttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctatgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttattgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcaggcaatactgcccattggagcacgaagccgccaatttgtcaacgaattccttgtgggctacccccaaccatcgccaatggagatttcattagcaccaacagagagaattttcactatggatcagtggtgacctaccgctgcaatcttggaagcagagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccagagttaccaagctgctccagggtgtgtcagccgcctccagaaatcctgcatggtgagcataccccaagccatcaggacaacttttcacctgggcaggaagtgttctacagctgtgagcctggctatgacctcagaggggctgcgtctctgcactgcacaccccagggagactggagccctgaagccccgagatgtgcagtgaaatcctgtgatgacttcttgggtcaactccctcatggccgtgtgctatttccacttaatctccagcttggggcaaaggtgtcctttgtctgtgatgaagggtttcgcttaaagggcagttccgttagtcattgtgtcttggttggaatgagaagcctttggaataacagtgttcctgtgtgtgaacatatcttttgtccaaatcctccagctatccttaatgggagacacacaggaactccctctggagatattccctatggaaaagaaatatcttacacatgtgacccccacccagacagagggatgaccttcaacctcattggggagagcaccatccgctgcacaagtgaccctcatgggaatggggtttggagcagccctgcccctcgctgtgaactttctgttcgtgctggtcactgtaaaaccccagagcagtttccatttgccagtcctacgatcccaattaatgactttgagtttccagtcgggacatctttgaattatgaatgccgtcctgggtattttgggaaaatgttctctatctcctgcctagaaaacttggtctggtcaagtgttgaagacaactgtagacgaaaatcatgtggacctccaccagaacccttcaatggaatggtgcatataaacacagatacacagtttggatcaacagttaattattcttgtaatgaagggtttcgactcattggttccccatctactacttgtctcgtctcaggcaataatgtcacatgggataagaaggcacctatttgtgagatcatatcttgtgagccacctccaaccatatccaatggagacttctacagcaacaatagaacatcttttcacaatggaacggtggtaacttaccagtgccacactggaccagatggagaacagctgtttgagcttgtgggagaacggtcaatatattgcaccagcaaagatgatcaagttggtgtttggagcagccctccccctcggtgtatttctactaataaatgcacagctccagaagttgaaaatgcaattagagtaccaggaaacaggagtttctttaccctcactgagatcatcagatttagatgtcagcccgggtttgtcatggtagggtcccacactgtgcagtgccagaccaatggcagatgggggcccaagctgccacactgctccagggtgtgtcagccgcctccagaaatcctgcatggtgagcataccctaagccatcaggacaacttttcacctgggcaggaagtgttctacagctgtgagcccagctatgacctcagaggggctgcgtctctgcactgcacgccccagggagactggagccctgaagcccctagatgtacagtgaaatcctgtgatgacttcctgggccaactccctcatggccgtgtgctacttccacttaatctccagcttggggcaaaggtgtcctttgtttgcgatgaagggttccgattaaaaggcaggtctgctagtcattgtgtcttggctggaatgaaagccctttggaatagcagtgttccagtgtgtgaacaaatcttttgtccaaatcctccagctatccttaatgggagacacacaggaactccctttggagatattccctatggaaaagaaatatcttacgcatgcgacacccacccagacagagggatgaccttcaacctcattggggagagctccatccgctgcacaagtgaccctcaagggaatggggtttggagcagccctgcccctcgctgtgaactttctgttcctgctgcctgcccacatccacccaagatccaaaacgggcattacattggaggacacgtatctctatatcttcctgggatgacaatcagctacatttgtgaccccggctacctgttagtgggaaagggcttcattttctgtacagaccagggaatctggagccaattggatcattattgcaaagaagtaaattgtagcttcccactgtttatgaatggaatctcgaaggagttagaaatgaaaaaagtatatcactatggagattatgtgactttgaagtgtgaagatgggtatactctggaaggcagtccctggagccagtgccaggcggatgacagatgggaccctcctctggccaaatgtacctctcgtacacatgatgctctcatagttggcactttatctggtacgatcttctttattttactcatcattttcctctcttggataattctaaagcacagaaaaggcaataatgcacatgaaaaccctaaagaagtggctatccatttacattctcaaggaggcagcagcgttcatccccgaactctgcaaacaaatgaagaaaatagcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcct

SEQ ID NO: 6502 - DNA, 2152 bp, Homo sapiens
ggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgaattccttgtgggctaccccccaccatcgccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggcccggcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacccgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttgggaaaacagtaaattacacatgcgacccccacccagacagagggacgagcttcgacctcattggagagagcaccatccgctgcacaagtgaccctcaagggaatggggtttggagcagccctgcccctcgctgtggaattctgggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggcaccgactcattggtcactcatctgctgaatgtatcctctcgggcaatgctgcccattggagcacgaagccgccaatttgtcaacgatcatgccatcttccctgtgagttgtttggaagatgagctttctacattttggggagcaaagacgaatgagcaattgcaagctaacaaggaatataaaatgtgtataatcctgggtttagtgatggtgtgaggaaatcagcaatttcaaacccagttggtgggaggataagtgggaacaaactttgtagaaggccaataaactggctgggcactgccctacggtagagtaggacacagtattcagttcttccaagatcagacgagattgggcgcatttagggtggtatggttgtagatcagtatccagttctttttattatttctgaatctgtaagtatcatgtttattatatgtaatattgtatatttgtactttgtctttgttagttcttccagagcttttgttcttattatttaataaagatgttatactg

SEQ ID NO: 6503 - DNA, 1453 bp, Homo sapiens
aaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggttt

SEQ ID NO: 6504 - DNA, 1788 bp, Homo sapiens
ggctggctttcggtttctctgctcacctccggataaatcacggggtctcccgcgccgctcatggcgcctcccgtccgtctcgagcgtccctttccttcccggcgctttcctgggttgcttctggcggccctggtgttgctgctgtcctccttctccgatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggcaccgactcattggtcactcatctgctgaatgtatcctctcgggcaatactgcccattggagcatgaagccaccaatttgtcaacaaatcttttgtccaaatcctccagctatccttaatgggagacacacaggaactccccttggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaacagtaagtacctacttat

SEQ ID NO: 6505 - DNA, 4240 bp, Homo sapiens
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggctgccagtcacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 6506 - DNA, 4063 bp, Homo sapiens
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 6507 - DNA, 3877 bp, Homo sapiens
caccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 6508 - DNA, 3841 bp, Homo sapiens
ccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaaggaaatcacctgcccaccaccccctgttatctacaatggggcacacaccgggagttccttagaagattttccatatggaaccacggtcacttacacatgcctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagcacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaac

SEQ ID NO: 6509 - DNA, 1163 bp, Homo sapiens
ccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctcc

SEQ ID NO: 6510 - DNA, 1044 bp, Homo sapiens
gcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaaggga

SEQ ID NO: 6511 - DNA, 977 bp, Homo sapiens
gcccttcccgcctctggggaagggaacttccgcttcggaccgagggcagtaggctctcggctcctggtcccactgctgctcagcccagtggcctcacaggacaccagcttcccagccctgtcaggttgaaatcagcattgccaagaggctcagagaggttaaggcacttgcctgaggttatgcagccggtagcagatggggctttaaagtcaagtgggcctgactccatgttgcggaaagggactgctggaccgaaggagatggaaaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactc

SEQ ID NO: 6512 - DNA, 1254 bp, Homo sapiens
gtggatgttcccccaggacagcgtgttctccccacagctgctgagttggcagaaccaaacttgccacccacccgtctcatttacagtaaatccagtgggttgcagaaataggacctgaaactgcctgagggcagcagggtggggggacagtgaggggacgggaaaggggccagcctgctggtccatgggaggggaccgtcaggggaaagcccttcccgcctctggggaagggaacttccgcttcggaccgagggcagtaggctctcggctcctggtcccactgctgctcagcccagtggcctcacaggacaccagcttcccaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagccccgcagtggcaagttcacctgcaaggtgcccggtctctactacttcacctaccacgccagctctcgagggaacctgtgcgtgaacctcatgcgtggccgggagcgtgcacagaaggtggtcaccttctgtgactatgcctacaacaccttccaggtcaccaccggtggcatggtcctcaagctggagcagggggagaacgtcttcctgcaggccaccgacaagaactcactactgggcatggagggtgccaacagcatcttttccgggttcctgctctttccagatatggaggcctgacctgtgggctgcttcacatccaccccggctccccctgccagcaacgctcactctacccccaacaccaccccttgcccaaccaatgcacacagtagggcttggtgaatgctgctgagtgaatgagtaaataaactcttcaaggccaagggaca

SEQ ID NO: 6513 - DNA, 677 bp, Homo sapiens
agcaggtacaattatggtcccatcctatagcagagaaaattggggctcccttgactgacaacacatcaactggcaagtggcagaggcgggattggaatcaaaggctctgactgtaagccagcactcaggcagcgggcccgccacatgatgctcactgaggaacacccctgcccagtgtagaagaagatcacgaggaggcgtctgacacagtatgatgatgaagatcccatggggcagcatcccagtactgatgttgctcctgctcctgggcctaatcgatatctcccaggcccagctcagctgcaccgggcccccagccatccctggcatcccgggtatccctgggacacctggccccgatggccaacctgggaccccagggataaaaggagagaaagggcttccagggctggctggagaccatggtgagttcggagagaagggagacccagggattcctgggaatccaggaaaagtcggccccaagggccccatgggccctaaaggtggcccaggggcccctggagccccaggccccaaaggtgaatcgggagactacaaggccacccagaaaatcgccttctctgccacaagaaccatcaacgtccccctgcgccgggaccagaccatccgcttcgaccacgtgatcaccaacatgaacaacaattatgagcccc

SEQ ID NO: 6514 - DNA, 1089 bp, Homo sapiens
tgggagaggggaagcagatctgaggacatctctgtgccaggccagaaaccgcccacctgcaggtgaggcccggacccctgcccaggtatgggcagatggccgtttcctccaccttccgccaccttcctgaaatgtggtgccaggggcagcttggtgtgtgaggggaaggagggttcccactcctgctgggccccggggcctgggctgaagaaaaggccccaccatccatccatgttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccc

SEQ ID NO: 6515 - DNA, 1183 bp, Homo sapiens
agacaccgtgtcctcttgcctgggagaggggaagcagatctgaggacatctctgtgccaggccagaaaccgcccacctgcaggtgaggcccggacccctgcccagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 6516 - DNA, 1163 bp, Homo sapiens
ctcagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacata

SEQ ID NO: 6517 - DNA, 1500 bp, Homo sapiens
gcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctccgctccctccggggtggcgcgcccgggggaggggggagttgggggctggatagcttcccagcaccctcagagcccccgcccggctgtgccccgtctgaccaaagttataataaaaacattttcaccccgca

SEQ ID NO: 6518 - DNA, 2043 bp, Homo sapiens
gacatgagggctccgtctcccgagtgatggcagcgcgcgctgcttcgccgcctccgccgctcagccccggactccttacgtcagggtagcggggtcccccctccgcgcgggagccagcgaacagcgagagagcacagcagagcgcgccgcggagccggggcgccctcactgcgctaggagccccactaaacccagcggagcggagcctggcgggaggcagcgccgcggagccagcgccggacgccgcaagcagactccccggccagcgcaagcactccctggccggcgccggaccctcggggcgccggattcgtcttgtgtgccccacgtcatgcgcgcgggcgtccgcggctctcccgaccagccccagcgcggtgggcccaggctcagaggtcccggcgcctctcgctgaagtagttgggtagccggggctgggggtcgccacgtcgggggcgcggccaggacccgcggagccggtccccgagcgcggggagcggggccgcccgcgccgccccaccattacctccccgggcggcaaggaggagctggtggcggtcgcctcccggctgtggcagcggcggcggcgtgcctgcctggcggccgtcggcgtactcttggccatggcgctcgggctgctcatcgccgtgccgctgctgctgcaggcggcgccccgaggcgccgcgcactatgagatgatgggcacctgccgcatgatctgcgacccttacactgccgcgcccggcggggagcccccgggtgcaaaggcgcagccacccggacccagcaccgccgccctggaagtcatgcaggacctcagcgccaaccctcctcctcctttcatccagggacccaagggcgacccggggcgaccgggcaagccagggccgcgggggccccctggagagccgggcccgcctggacccaggggccctccgggagagaagggcgactcggggcggcccgggctgccagggctgcaactgacggcgggcacggccagcggcgtcggggtggtgggcggcggggccggggtaggtggcgattccgagggtgaagtgaccagtgcgctgagcgccaccttcagcggccccaagatcgccttctatgtgggtctcaagagcccccacgaaggctatgaggtgctgaagttcgatgacgtggtcaccaacctcggcaatcactatgaccccaccacgggcaagttcagctgccaggtacgcggcatctacttcttcacctaccacatcctcatgcgcggcggcgacggcaccagcatgtgggcggacctctgcaagaacgggcaggtccgggccagcgccattgcacaggacgccgaccagaactacgactacgccagtaacagcgtggtgctgcacttggattcaggggacgaagtgtatgtgaagctggatggcgggaaggctcacggaggcaataataacaagtacagcacgttctcgggctttcttctgtacccggattaggggcgcggggggtgcgaggcggggtggctgcaggccgcccggtctccgcccgggcgcggctccttggcaaaggccactctcgattcataacacttcctgacatctcctttggaaaagacaaatccctgcgtcctccctgccccgctcctggcctcagtgcgtctgcgacccaccacgctcagggctgtgctcctggtctccatccccatcccggcaagggaggaagggacgcccgagcccttgaggcggcggcacagactttgcaaacctgattagactggacaggcagggccgggagcctgccctcctcagacagcctcctcccagtgcctagaagcggagggctccgggccctggccagggaggtaggccagagggagcgcgggcttcctggggcgtccttctttgtgacccgaaatacttgtgcagatttccctgtccatcagccaaaaccccacccacagcagaattccagcaaacagaaaattcacctctccacaccgcattccctcctgactcagactcaccgcgatgcattaaattatgtttttagactatg

SEQ ID NO: 6519 - DNA, 2039 bp, Homo sapiens
atcctccccacccacgcacccctgctgagaacatgtctgtgaggttcagggtgggcagagaggagaatgcccagtggtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagagggaattcaggtggtggctggagtcgtagacgtttcagctggaagagtctcctggtccaccagctctcaaacttgctgcacacgggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactga

SEQ ID NO: 6520 - DNA, 2425 bp, Homo sapiens
acaaacagggatttcaaaaccaaaactaaattaaagtggaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaacccaaagggcccctttctttcttctgaggattgcagaggatatagttatcaatctctagttgtcactttcctcttccactttgataccattgggtcattgaatataactttttccaaataaagttttatgagaaatgccagtgtgcaaaa

SEQ ID NO: 6521 - DNA, 2112 bp, Homo sapiens
ttccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagagggaattcaggtggtggctggagtcgtagacgtttcagctggaagagtctcctggtccaccagctctcaaacttgctgcacacgggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactga

SEQ ID NO: 6522 - DNA, 3394 bp, Homo sapiens
atttccaggaacttcctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgagacgcaaaggcacagtgtctgccagggggacagtggcagcgtctatgtggtatgggacaatcatgcccatcactgggtggccacgggcattgtgtcctggggcatagggtgtggcgaagggtatgacttctacaccaaggtgctcagctatgtggactggatcaagggagtgatgaatggcaagaattgaccctgggggcttgaacagggactgaccagcacagtggaggccccaggcaacagagggcctggagtgaggactgaacactggggtaggggttgggggtggggggttgggggaggcagggaaatcctattcacatcactgttgcaccaagccactgcaagagaaacccccacccggcaagcccgccccatcccagacaggaagcagagtcccacagaccgctcctcctcaccctctacctccctgtgctcatgcactaggccccgggaagcctgtacatctcaacaactttcgccttgaatgtccttagaaccgccttcccctacttcatctgttgacacagcttttatactcacctgtggaagagtcagctactcacccgctattagagtatggaggaaggggttttcattgcattgcatttctgaaacattcctaagaccctttagttgaccttcaaatattcaagctattctgcagctccaagatgcaattatagaaacagctccttttttattttatgtcctctatatgccaggtgcttcacctgttatttcacttaatcctcataccatatttgcaaaggatgtgttattatctatgtgtgacaaatgaggaaactgaggctcaggggataaagggacttgcccaagtcccacagctggtgtgtgactgcagagactgtgctcttcccagtgtgctgcaatacttctcaaccctcctctaacctgctgtgtcacccgctttccctcccagcccccacatccttaccattttccctccctgggaattcctgcttctgcgaaaatggtatcctctagctcacactttcctaatggccccatctcctgcagaagccaggtgagcccagcactggactgaagttcttgcagacaccccacctgtgcccctatcatcaggggaactgctccacctgagaggaccaactctttaatttttagtaaaacctggaggtgatgggccgggcgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagagagaagagaggtaatttgttagcatcaagagtcaagttgctatatggtcaaaggttaaatttatctctaaaaaatggcaggattcaaagttgtacatacatgtgattacttctgttttttacacccacatacagtacaaaagattattaaaaatattcccaaaaggcaggtgcaatgatgcacacttatacccccagccactcaggaggctgatgcaagaggatcgcttgagcccaggagttgaagtccagcctaagcaacatagtgaaaccccatcgccaaaaatataataataattctctcaaaatactaaacagaggtggttttattgataagattttggctgtttggttttccactattctctattggctaaaatttgtttaatgagcatgaaatgtttttattttattttgcttatttttatgattgcaaaaaatgatatgagtttctccctgccaaggcaaaaaaatatatatatacctata

SEQ ID NO: 6523 - DNA, 1542 bp, Homo sapiens
ctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcttctctggggagtcctccaggcttgcccaacccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctgtcacaatctcattcgtcggttcggatccaagccagttctgtggtcagcaaggctcccctctgggcaggccccctggtcagagggagtttgtatcctcagggaggagtttgcggctgaccttccgcacacagccttcctcggagaacaagactgcccacctccacaagggcttcctggccctctaccaaaccgtggctgtgaactatagtcagcccatcagcgaggccagcaggggctctgaggccatcaacgcacctggagacaaccctgccaaggtccagaaccactgccaggagccctattatcaggccgcggcagcaggggcactcacctgtgcaaccccagggacctggaaagacagacaggatggggaggaggttcttcagtgtatgcctgtctgcggacggccagtcacccccattgcccagaatcagacgaccctcggttcttccagagccaagctgggcaacttcccctggcaagccttcaccagtatccacggccgtgggggcggggccctgctgggggacagatggatcctcactgctgcccacaccatctaccccaaggacagtgtttctctcaggaagaaccagagtgtgaatgtgttcttgggccacacagccatagatgagatgctgaaactggggaaccaccctgtccaccgtgtcgttgtgcaccccgactaccgtcagaatgagtcccataactttagcggggacatcgccctcctggagctgcagcacagcatccccctgggccccaacgtcctcccggtctgtctgcccgataatgagaccctctaccgcagcggcttgttgggctacgtcagtgggtttggcatggagatgggctggctaactactgagctgaagtactcgaggctgcctgtagctcccagggaggcctgcaacgcctggctccaaaagagacagagacccgaggtgttttctgacaatatgttctgtgttggggatgaggcaggagaatcacttgaacctgggaggcggaggttgcagtgagctaagatcacgccactgcactccagcctgcggacagaccaagacttcatcccccccaaaaaaaaaagattggaggtgatttacagtgaaagacacaaataaaatacaactgttcaatggaaatagaaaataaacaccataaaagag

SEQ ID NO: 6524 - DNA, 2972 bp, Homo sapiens
attaagcaatcggtgaaattccccattcctcctttccccgctggagccctggatagagggctctctggcctgggaggaggacgctgtccttgtttcaaaagcagagggagctccaagatcaaggctgagtttccctaagtcatggtctcccagccccctctgtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 6525 - DNA, 2635 bp, Homo sapiens
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctt

SEQ ID NO: 6526 - DNA, 2844 bp, Homo sapiens
gtttagatcagggaatttcagacatgcacactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagataaagatgaatgtagtggtagggctcaactctggaatcatatgtcagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtgcatctttctctgttgctcaagctggagtgcagtggtgcaatcacagctcactgtagccttgatctcttgggctcaattgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggagaagagagagagagaggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 6527 - DNA, 1034 bp, Homo sapiens
agacagggctgcttgaggagatgaggtgatcacggttaaagaagaggggctgtcctacatggatgatcatgatgcgccaagactgttgaaaacctgagtggaaatgggagcatcgttcttgagggcaggagagagactgataccgcgggggtggggctggtggaggacaatagaggaagaagaaaactgggagaaagtactcgattcctttggagaaaaattaggagaaagtctagagaagcaatgagggaaggatacaatttagctatagtctagaaagttagtcgaagttaactagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatga

SEQ ID NO: 6528 - DNA, 3076 bp, Homo sapiens
agaaaaataaaaagaatgcagcaggccaggttagcaggaacgttaagacggtgacggagaacagcaaagcctggaagcaagccgccgtggagaaggaagaactgtgctgagtacttcactctgttgcccaggctggagtgcagcggcacaatcacagctcactgcagtttcaacttcctgggttcaagtgatcctcctgcctgagcctcccaagtagctaggactataggctcctcctggctgttacactttctcagaccttccttgattatgatgacctcgaagttttgaggagtactgggaaagagtattataggatgccccctactggaatttgtcagatgtttttctcatgattatacagggattatggcttttggggaggaagatctcagagggtctcaccatgttgcccaggctgatctcaaactcctgaactcaagcaaccctcctgctttggcctcctaaagtattggtattacaggtgtgagccaccacacctggcccacaggacatggattctgaacaactggcataaatcgactggcctcaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagcaaa

SEQ ID NO: 6529 - DNA, 667 bp, Homo sapiens
gtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatac

SEQ ID NO: 6530 - DNA, 573 bp, Homo sapiens
gtcatttggctgtcccttttctccttcctcgcacaaccctgtatcagtggggcagcacttccttctcagaccgcttgtcccagggtccctgccttcccctagtgaaagaagctcctgcctccatcggtgggcgttgggagcatcagcggagatgcacgcaatgataaacagcagacagggctgcttgaggagatgaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagt

SEQ ID NO: 6531 - DNA, 2850 bp, Homo sapiens
gagcgtgggggcagtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 6532 - DNA, 2785 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6533 - DNA, 2835 bp, Homo sapiens
acacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 6534 - DNA, 1895 bp, Homo sapiens
tgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 6535 - DNA, 2835 bp, Homo sapiens
acacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 6536 - DNA, 1895 bp, Homo sapiens
tgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccaca

SEQ ID NO: 6537 - DNA, 2835 bp, Homo sapiens; identical to SEQ ID NO: 6535

SEQ ID NO: 6538 - DNA, 561 bp, Homo sapiens
gtattttgctgttggttctgtggatgacaggtgacaaaacaggcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggaga

SEQ ID NO: 6539 - DNA, 576 bp, Homo sapiens
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 6540 - DNA, 561 bp, Homo sapiens; identical to SEQ ID NO: 6538

SEQ ID NO: 6541 - DNA, 2835 bp, Homo sapiens; identical to SEQ ID NO: 6535

SEQ ID NO: 6542 - DNA, 605 bp, Homo sapiens
atagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcgga

SEQ ID NO: 6543 - DNA, 576 bp, Homo sapiens; identical to SEQ ID NO: 6539

SEQ ID NO: 6544 - DNA, 1281 bp, Homo sapiens
atattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaag

SEQ ID NO: 6545 - DNA, 2835 bp, Homo sapiens; identical to SEQ ID NO: 6535

SEQ ID NO: 6546 - DNA, 1281 bp, Homo sapiens
atattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaag

SEQ ID NO: 6547 - DNA, 1281 bp, Homo sapiens; identical to SEQ ID NO: 6546

SEQ ID NO: 6548 - DNA, 576 bp, Homo sapiens; identical to SEQ ID NO: 6539

SEQ ID NO: 6549 - DNA, 1895 bp, Homo sapiens; identical to SEQ ID NO: 6536

SEQ ID NO: 6550 - DNA, 1281 bp, Homo sapiens; identical to SEQ ID NO: 6546

SEQ ID NO: 6551 - DNA, 403 bp, Homo sapiens
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtgga

SEQ ID NO: 6552 - DNA, 1895 bp, Homo sapiens; identical to SEQ ID NO: 6536

SEQ ID NO: 6553 - DNA, 1895 bp, Homo sapiens; identical to SEQ ID NO: 6536

SEQ ID NO: 6554 - DNA, 1281 bp, Homo sapiens; identical to SEQ ID NO: 6546

SEQ ID NO: 6555 - DNA, 539 bp, Homo sapiens
acgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtgga

SEQ ID NO: 6556 - DNA, 539 bp, Homo sapiens; identical to SEQ ID NO: 6555

SEQ ID NO: 6557 - DNA, 2150 bp, Homo sapiens
cccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcgtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggcaggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6558 - DNA, 539 bp, Homo sapiens; identical to SEQ ID NO: 6555

SEQ ID NO: 6559 - DNA, 1281 bp, Homo sapiens; identical to SEQ ID NO: 6546

SEQ ID NO: 6560 - DNA, 561 bp, Homo sapiens; identical to SEQ ID NO: 6538

SEQ ID NO: 6561 - DNA, 435 bp, Homo sapiens
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 6562 - DNA, 605 bp, Homo sapiens; identical to SEQ ID NO: 6542

SEQ ID NO: 6563 - DNA, 561 bp, Homo sapiens; identical to SEQ ID NO: 6538

SEQ ID NO: 6564 - DNA, 539 bp, Homo sapiens; identical to SEQ ID NO: 6555

SEQ ID NO: 6565 - DNA, 605 bp, Homo sapiens; identical to SEQ ID NO: 6542

SEQ ID NO: 6566 - DNA, 2434 bp, Homo sapiens
aaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 6567 - DNA, 605 bp, Homo sapiens; identical to SEQ ID NO: 6542

SEQ ID NO: 6568 - DNA, 561 bp, Homo sapiens; identical to SEQ ID NO: 6538

SEQ ID NO: 6569 - DNA, 605 bp, Homo sapiens; identical to SEQ ID NO: 6542

SEQ ID NO: 6570 - DNA, 2835 bp, Homo sapiens; identical to SEQ ID NO: 6535

SEQ ID NO: 6571 - DNA, 605 bp, Homo sapiens; identical to SEQ ID NO: 6542

SEQ ID NO: 6572 - DNA, 576 bp, Homo sapiens; identical to SEQ ID NO: 6539

SEQ ID NO: 6573 - DNA, 1895 bp, Homo sapiens; identical to SEQ ID NO: 6536

SEQ ID NO: 6574 - DNA, 435 bp, Homo sapiens
ctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggct

SEQ ID NO: 6575 - DNA, 403 bp, Homo sapiens; identical to SEQ ID NO: 6551

SEQ ID NO: 6576 - DNA, 561 bp, Homo sapiens; identical to SEQ ID NO: 6538

SEQ ID NO: 6577 - DNA, 561 bp, Homo sapiens; identical to SEQ ID NO: 6538

SEQ ID NO: 6578 - DNA, 1999 bp, Homo sapiens
agttgacgatgtccctaacagcgaattccaaggcgcccgtgtagcaggagaggagcaagtcggccacgatgcgtgcactgtgcatcagggagacctgcagctccgagctggggttcagcaggaactggtcccgcaggaaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccac

SEQ ID NO: 6579 - DNA, 1906 bp, Homo sapiens
cattttcccctgagagcggcctcggagatggctgtgactgtcctaagctgggagctgcaagggagaattcctgtcattcctggcctcagttctgcagggaccgagggcgagacacgcctgggcccaggtgtggcgtctctgtccccatctggttttagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctca

SEQ ID NO: 6580 - DNA, 1906 bp, Homo sapiens; identical to SEQ ID NO: 6579

SEQ ID NO: 6581 - DNA, 1906 bp, Homo sapiens; identical to SEQ ID NO: 6579

SEQ ID NO: 6582 - DNA, 2785 bp, Homo sapiens; identical to SEQ ID NO: 6532

SEQ ID NO: 6583 - DNA, 2150 bp, Homo sapiens; identical to SEQ ID NO: 6557

SEQ ID NO: 6584 - DNA, 2602 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6585 - DNA, 2602 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6586 - DNA, 1999 bp, Homo sapiens; identical to SEQ ID NO: 6578

SEQ ID NO: 6587 - DNA, 2785 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6588 - DNA, 2439 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6589 - DNA, 2439 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttcaaggagagcgcctccctcatggtggacaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6590 - DNA, 2701 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcagccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6591 - DNA, 2150 bp, Homo sapiens; identical to SEQ ID NO: 6557

SEQ ID NO: 6592 - DNA, 1906 bp, Homo sapiens; identical to SEQ ID NO: 6579

SEQ ID NO: 6593 - DNA, 2150 bp, Homo sapiens; identical to SEQ ID NO: 6557

SEQ ID NO: 6594 - DNA, 2439 bp, Homo sapiens; identical to SEQ ID NO: 6588

SEQ ID NO: 6595 - DNA, 2785 bp, Homo sapiens; identical to SEQ ID NO: 6532

SEQ ID NO: 6596 - DNA, 2785 bp, Homo sapiens; identical to SEQ ID NO: 6532

SEQ ID NO: 6597 - DNA, 2701 bp, Homo sapiens
agtacacaaagcctgtgggggagatctattgaccctatagatatattagcatcagggagacagggcaaaggtttcacccttcagttcagtccccaatccctgcttattatttccctaacagaagaccatcccccttgccactccctggtttttcttctctggcagcaatgaagcagctgctgacccagctctagttttcgggaagtcagatgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctgtgcgctgtccagcccctgtctcctttgagaatggcatttataccccacggctggggtcctatcccgtgggtggcaatgtgagcttcgagtgtgaggatggcttcatattgcggggctcgcctgtgcgtcagtgtcgccccaacggcatgtgggatggagaaacagctgtgtgtgataatggggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcttcagctttgagatcaatgtgagcgttgccattatcacctttgcctcagagcccaaagtcctcatgtctgtcctgaacgacaactcccgggatatgactgaggtgatcagcagcctggaaaatgccaactataaagatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggagaatctgggggagcagttttccttgagcggagattcaggttttttcaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttcc

SEQ ID NO: 6598 - DNA, 2785 bp, Homo sapiens; identical to SEQ ID NO: 6532

SEQ ID NO: 6599 - DNA, 1999 bp, Homo sapiens; identical to SEQ ID NO: 6578

SEQ ID NO: 6600 - DNA, 2439 bp, Homo sapiens; identical to SEQ ID NO: 6588

SEQ ID NO: 6601 - DNA, 2439 bp, Homo sapiens; identical to SEQ ID NO: 6588

SEQ ID NO: 6602 - DNA, 2439 bp, Homo sapiens; identical to SEQ ID NO: 6588

SEQ ID NO: 6603 - DNA, 2150 bp, Homo sapiens; identical to SEQ ID NO: 6557

SEQ ID NO: 6604 - DNA, 2785 bp, Homo sapiens; identical to SEQ ID NO: 6532

SEQ ID NO: 6605 - DNA, 1999 bp, Homo sapiens; identical to SEQ ID NO: 6578

SEQ ID NO: 6606 - DNA, 1999 bp, Homo sapiens; identical to SEQ ID NO: 6578

SEQ ID NO: 6607 - DNA, 5132 bp, Homo sapiens
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 6608 - DNA, 2243 bp, Homo sapiens
tgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggtgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaacta

SEQ ID NO: 6609 - DNA, 708 bp, Homo sapiens
agggtattatgataaactctgatctggggaggaaccaggactacatagatcaaggcagttttcttctttgagaaactatcccagatatcatcatagagtcttctgctcttcctcaactaccaaaggctgtcatttccttgaagacatggatcccataacatttattctagtgctttatgacaagttggaattcaatgactatttattaaattgagttctttcagcagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagt

SEQ ID NO: 6610 - DNA, 1117 bp, Homo sapiens
cattcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 6611 - DNA, 1113 bp, Homo sapiens
attcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 6612 - DNA, 978 bp, Homo sapiens
aagcgagaacaatgtgtcactgcaggactttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaa

SEQ ID NO: 6613 - DNA, 949 bp, Homo sapiens
gcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctg

SEQ ID NO: 6614 - DNA, 1001 bp, Homo sapiens
ggtgtgcgtgctgtcttatggttgcgtggcgagtttctgcttcagatgagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtattccacagactcgtcctcttcccttccagccatgttctcccctatttctttttcttttgagacagagtcttgctctgtttcccaggctggagtgcagtggcagaatcttggctcactgcaacctccacctcccaggttcaagcagttctcatgcctcagcctcccaagtagctgggattacaggtgcgcacccacgctgggctaatttttgtatttttagtagagactgggtttcaccatgttggccaggctggtctcaaattcctgacctcaggtgatccacccccttcagcctcccaaagtgctgggattacaggtgtgagccactgctcccaccttctcccctttttctgatactctctttgatatagtttggatgtgtgttcctgctcaaatctcatattgaattgtaatctccagtgttggaggtggtgcttggtgggaggtgactggatcatgcgggtggatttctcatgaatggtctagcaccatctccctaggtactgtcctcatgacagcgagtgagttctcatgagatctggttgtttaaaagtgtgtaacgcctcctccctctctcgttcctgcacctgttatgtgagatgcct

SEQ ID NO: 6615 - DNA, 743 bp, Homo sapiens
caaaaagactggtcaactggatttgcattcccagaaaccaggaaatttctgaaactgagttttaaacctggcaactcttttaccatccctttgtatttttgcagttcctccctataccagcttccttacagctgttctgatttcctgtcggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgat

SEQ ID NO: 6616 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagtggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccactgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6617 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6618 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6619 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6620 - DNA, 5269 bp, Homo sapiens
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtca

SEQ ID NO: 6621 - DNA, 813 bp, Homo sapiens
atgtgccccgaggacagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtgggtga

SEQ ID NO: 6622 - DNA, 5181 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagtggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 6623 - DNA, 2054 bp, Homo sapiens
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 6624 - DNA, 5268 bp, Homo sapiens
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtc

SEQ ID NO: 6625 - DNA, 5268 bp, Homo sapiens
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctagatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtc

SEQ ID NO: 6626 - DNA, 2054 bp, Homo sapiens
agaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 6627 - DNA, 979 bp, Homo sapiens
agacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtgggtga

SEQ ID NO: 6628 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagttcagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6629 - DNA, 5220 bp, Homo sapiens
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 6630 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6631 - DNA, 5460 bp, Homo sapiens
agagtcaactctgccccgaggcctagcttggccagaaggtagcagacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagactttgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggca

SEQ ID NO: 6632 - DNA, 982 bp, Homo sapiens
atgtgccccgaggacagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgcca

SEQ ID NO: 6633 - DNA, 5220 bp, Homo sapiens
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagactttgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 6634 - DNA, 1276 bp, Homo sapiens
agacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccctgtgctgggcctcagcatgtacagacaggaatacagcagcctgcgccct

SEQ ID NO: 6635 - DNA, 5268 bp, Homo sapiens
gacagacagacggatctaacctctcttggatcctccagccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagttcagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccaccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtc

SEQ ID NO: 6636 - DNA, 2054 bp, Homo sapiens; identical to SEQ ID NO: 6626

SEQ ID NO: 6637 - DNA, 2076 bp, Homo sapiens
atgggaagccagtgcagggggtggcatatgtgcgctttgggctcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagc

SEQ ID NO: 6638 - DNA, 5462 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 6639 - DNA, 3461 bp, Homo sapiens
caagccggcccacaccacgcccggtccgggccttcccgcctttgccgccggcccccactgctcgggccggatgccggggaacgggctcggccaggtctgacgctcaccgcctagaagccgagccgagcagtcccgcaggctgaggtagagcgggagaagttcgggctctttcctcaggggcccagcggcgcggcagccattttgttgtgttgtgccggttgccgaggggccgcgcgcgcgtggtcggggctagtctcagccacgcccctctccctctccggtactgttggaagggacgcggaggcgtttcccgcctcttttgcagccagcgcgctaggatgccggggagtcttgggcgcgaggcttccggccgcgcggggccgacgggatgcggtgccttcgccttcggattgcgttgcagatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcctggaaacaggaaatcattggaacatttttcattctga

SEQ ID NO: 6640 - DNA, 3661 bp, Homo sapiens
ctaaaatatacccgtctctcttaattttgtatgtcttcaacataacattcattaaattttattctgaaactgagtcttaaaaactgaaatacttttaaagagagatgtttctagcttaaatatttcatcatatagtaagattcctgctgagagctcataataagaaatatgaaaccagttactctggacttggattttgatgtgctgaagtatctgctggtatttcttcaagtcatagatgcataggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgcgcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgacgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcgcaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 6641 - DNA, 3551 bp, Homo sapiens
ttgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgcgcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgacgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcgcaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 6642 - DNA, 4257 bp, Homo sapiens
attgaactgagaacatttgctgtgtttcctgatttatagatatgtttctaagaaacatatctataacttccaaacagtcccagctggctgtagctaaggctgtgtaattgataagatgcatctggtttcaaggcacagattaagtacaaggtcaggctcttgctgtcgttggagaatccggttggggtaggagctaaatctcaggaccacttgctctatatatgagtgccaagataatctagagcagggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaaaattgcctgtgttctacctgtactgatggatggcatacagagtcacccccaaaaacctttctacacagttggtgagaaggtgactgtttcctgttcaggtggcatgtccttagaaggtccttcagcatttctctgtggctccagccttaagtggagtcctgagatgaagaatgcccgctgtgtacaaaaagaaaatccgttaacacaggcagtgcctaaatgtcagcgctgggagaaactgcagaattcaagatgtgtttgtaaaatgccctacgaatgtggaccttccttggatgtatgtgctcaagatgagagaagcaaaaggatactgcctctgacagtttgcaagatgcatgttctccactgtcagggtagaaattacacccttactggtagggacagctgtactctgcctgcctcagctgagaaagcttgtggtgcctgcccactgtggggaaaatgtgatgctgagagcagcaaatgtgtctgccgagaagcatcggagtgcgaggaagaagggtttagcatttgtgtggaagtgaacggcaaggagcagacgatgtctgagtgtgaggcgggcgctctgagatgcagagggcagagcatctctgtcaccagcataaggccttgtgctgcggaaacccagtaggctcctggaggccctggtcagcttgcttggaatccagcaggcagctggggctgagtgaaaacatctgcacaactgggcactggacagcttttccttcttctccagtgtctaccttcctcctcaactcccagccatctgtataaacacaatcctttgttctcccaaatctgaatcgaattactcttttgcctcctttttaatgtcagtaaggatatgagcctttgcacaggctggctgcgtgttcttgaaataggtgttaccttctctgggccttggttttttaaaatctgtaaaattagaggattgcactagagaaacttgaatgctccattcaggcctatcattttattaagtatgattgacacagcccatgggccagaacacactctacaaaatgactaggataacagaaagaacgtgatctcctgattagagagggtggttttcctcaatggaaccaaatataaagaggacttgaacaaaaatgacagatacaaactatttctatcctgagtagtaatctcacacttcatcctatagagtcaaccaccacagataggaattccttattctttttttaatttttttaagacagagtctcactttgttgcccaggctggagcgcagtggggtgatctcatctccctgcaacctccgcctcctgggttcaagcgattcttgtgcctcagcttcccaagcagctgggattacaggtgcccgccaccacgcccagctaatttttgcatttttagtagagatggggtttcaccatgttggccacgctcgtctccaactcctgacctcaggtaatccgcctgccttggcctcccaaagtgctgggattacagacatgaaccaccacgcctggctggaatacttactcttgtcgggagattgaaccactaaaatgttagagcagaattcattatgctgtggtcacaggggtgtcttgtctgagaacaaatacaattcagtcttctctttggggttttagtatgtgtcaaacataggactggaagtttgcccctgttcttttttcttttgaaagaacatcagttcatgcctgaggcatgagtgactgtgcatttgagaatagttttccctattctgtggatacagtcccagagttttcagggagtacacaggtagattagtttgaagcattgaccttttatttattccttatttctctttcatcaaaacaaaacagcagctgtgggaggagaaatgagagggcttaaatgaaatttaaaataagctatattatacaaatactatctctgtattgttctgaccctggtaaatatatttcaaaacttcagatgacaaggattagaacactcattaaagatgctattcttcagaa

SEQ ID NO: 6643 - DNA, 1575 bp, Homo sapiens
agggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagttctattttatgtggactcagaaaaattaaaacaaaatgattttaattcagtcgaagaaaagaaatgtaaatcctcaggttggcattttgtcgttaaattttcaagtcatggatgcaaggaactggaaaacgctttaaaagctgcttcaggaacccagaacaatgtattgcgaggagaaccgttcatcagagggggaggtgcaggcttcatatctggccttagttacctagagctggacaatcctgctggaaacaaaaggcgatattctgcctgggcagaatctgtgactaatcttcctcaagtcataaaacaaaagctgacacctttatatgagctggtaaaggaagtaccttgtgcctctgtgaaaaaactatacctgaaatgggctcttgaagagtatctggatgaatttgacccctgtcattgccggccttgtcaaaatggtggtttggctactgttgaggggacccattgtctgtgccattgcaaaccgtacacatttggtgcggcgtgtgagcaaggagtcctcgtagggaatcaagcaggaggggttgatggaggttggagttgctggtcctcttggagcccctgtgtccaagggaagaaaacaagaagccgtgaatgcaataacccacctcccagtgggggtgggagatcctgcgttggagaaacgacagaaagcacacaatgcgaagatgaggagctggagcacttgaggttgcttgaaccacattgctttcctttgtctttggttccaacagaattctgtccatcacctcctgccttgaaagatggatttgttcaagatgaaggtacaatgtttcctgtggggaaaaatgtagtgtacacttgcaatgaaggatactctcttattggaaacccagtggccagatgtggagaagatttacggtggcttgttggggaaatgcattgtcagaacggcaaaatatccaactggatgaaagttaatgaaactctcctggtggaacatcactag

SEQ ID NO: 6644 - DNA, 1143 bp, Homo sapiens
agggagaggcagagaggcaggcagcctgctgggctcttcctgctgttgaaaacttacccggcccttacagaggaaatcttcctcctctcttctgccctgaatgttttcccaaacatgaaggtgataagcttattcattttggtgggatttataggagagttccaaagtttttcaagtgcctcctctccagtcaactgccagtgggacttctatgccccttggtcagaatgcaatggctgtaccaagactcagactcgcaggcggtcagttgctgtgtatgggcagtatggaggccagccttgtgttggaaatgcttttgaaacacagtcctgtgaacctacaagaggatgtccaacagaggagggatgtggagagcgtttcaggtgcttttcaggtcagtgcatcagcaaatcattggtttgcaatggggattctgactgtgatgaagacagtgctgatgaagacagatgtgaggactcagaaaggagaccttcctgtgatatcgataaacctcctcctaacatagaacttactggaaatggttacaatgaactcactggccagtttaggaacagagtcatcaataccaaaagttttggtggtcaatgtagaaaggtgtttagtggggatggaaaagatttctacaggctgagtggaaatgtcctgtcctatacattccaggtgaaaataaataatgattttaattatgaattttacaatagtacttggtcttatgtaaaacatacgtcgacagaacacacatcatctagtcggaagcgctccttttttagatcttcatcatcttcttcacgcagttatacttcacataccaatgaaatccataaaggaaagagttaccaactgctggttgttgagaacactgttgaagtggctcagttcattaataacaatccagaatttttacaacttgctgagccattctggaaggagctttcccacctcccctctctgtatgactacagtgcctaccgaagattaatcgaccagtacgggacacattatctgcaatctgggtcgttaggaggagaatacagagttctattttatgtggactcagaaaaattaaaacaaaatgattttaattcagtcgaaaaaaaaaaaaaaaaaaaaaaaaaaaagaaa

SEQ ID NO: 6645 - DNA, 2356 bp, Homo sapiens
ttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaaaaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 6646 - DNA, 2037 bp, Homo sapiens
ggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggcttaa

SEQ ID NO: 6647 - DNA, 2065 bp, Homo sapiens
actttgcagagctatttgctcttggggacagaagctgacagtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaagggatcaagtccaggatcatggttttcgaggatccctgtgaccgaatctagcctacatttccagcacaatggacacttgtatgactctggccttcactctctctgggcgtttcttcatgctgctttctcagtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaaga

SEQ ID NO: 6648 - DNA, 2379 bp, Homo sapiens
attctggttggtttccagagtgacaggtaagtttttggtctgtgcaaagtctgtttccagtcactagtggctttctgtttactttgcagagctatttgctcttggggacagaagctgacagtggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccaggtatttgaattccatctgcgagtagaagaatagtctttggttctggaacagaaaatgctgagaccaccttcgtattggccaaaagagttttttgttcttacttactcttgtaatcaagtcagatgatgaaatcacaatcactgtgtcgtaagacctattatgtattgccactctgtgccagcaacttggaaacattagctataatcctcacagctattccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggctt

SEQ ID NO: 6649 - DNA, 855 bp, Homo sapiens
ctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgagacgcccgaggggctgtgcacgtggttgtcgctgagaccgactaccagagtttcgctgtcctgtacctggagcgggcggggcagctgtcagtgaagctctacgcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctc

SEQ ID NO: 6650 - DNA, 567 bp, Homo sapiens
agagtagactctgtcctgggacttggtggtgctacccttggcctcccacagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgagacgcccgaggggctgtgcacgtggttgtcgctgagaccgactaccagagtttcgctgtcctgtacctggagcgggcggggcagctgtcagtgaagctctacggggcccagggagtagtgacagacaggcctggtgtggga

SEQ ID NO: 6651 - DNA, 2713 bp, Homo sapiens
aaacaatgcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataatttttttttaaatttttcttccttaaactcctgtgatgtttccattttttgttccctaatgagaagtcaacagtgaaatacgccagaactgctttatcccacggaaaatgccaatctcttctaaaaaaaaacaaaattaaattaaaaacagaatgttggtttaaaaaacttcaaagtaattttcaaacggctttgtatggttaacatattctgccaggtccatgaccacacgtctgtaccatgcaatttaactcttatttacattgttatgtttagtttggttatttgcttaggtgtgcatacattcattcagcaaatgctgagcaccagccacgtgcacagcagttgcttttactagtcttagctctacgatttaaatccatgtgtccaagggggaaaacatattatatttgtaaccaaaaactactagtttaccagaggactgaagggagataaagaggagttggttaatgggtacaaaaatccagttagatgaaaggaataatatagatagtgttcagtagcagaatagaatgaacataaactattagtttaaattatgtgaaattccttctatttgatcatattttacaagaaaaaacatcaattttatatagtccaacttaatacctagccttatgagttgtataaggtaaggttacctacctgagaagctgattaacattggttgtacaatcttattcattagagaacatggtgcttagggtctgagaccttttgaaaggtctgagaactctttaaaaaaaggaaagaaagaaagaaaa

SEQ ID NO: 6652 - DNA, 1921 bp, Homo sapiens
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggcc

SEQ ID NO: 6653 - DNA, 1996 bp, Homo sapiens
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggcc

SEQ ID NO: 6654 - DNA, 2502 bp, Homo sapiens
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaagaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 6655 - DNA, 2502 bp, Homo sapiens
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 6656 - DNA, 2577 bp, Homo sapiens
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 6657 - DNA, 2577 bp, Homo sapiens
gcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaagaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 6658 - DNA, 2502 bp, Homo sapiens; identical to SEQ ID NO: 6655

SEQ ID NO: 6659 - DNA, 2862 bp, Homo sapiens
ggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 6660 - DNA, 2502 bp, Homo sapiens; identical to SEQ ID NO: 6655

SEQ ID NO: 6661 - DNA, 2577 bp, Homo sapiens; identical to SEQ ID NO: 6656

SEQ ID NO: 6662 - DNA, 2577 bp, Homo sapiens; identical to SEQ ID NO: 6656

SEQ ID NO: 6663 - DNA, 2577 bp, Homo sapiens; identical to SEQ ID NO: 6656

SEQ ID NO: 6664 - DNA, 2502 bp, Homo sapiens; identical to SEQ ID NO: 6655

SEQ ID NO: 6665 - DNA, 586 bp, Homo sapiens
aataaaaatcaatggtttccacatctctcagtgcctctatctggaggccaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacct

SEQ ID NO: 6666 - DNA, 3874 bp, Homo sapiens
atgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggaca

SEQ ID NO: 6667 - DNA, 3874 bp, Homo sapiens
atgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaagaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggaca

SEQ ID NO: 6668 - DNA, 3874 bp, Homo sapiens; identical to SEQ ID NO: 6666

SEQ ID NO: 6669 - DNA, 3874 bp, Homo sapiens; identical to SEQ ID NO: 6666

SEQ ID NO: 6670 - DNA, 3874 bp, Homo sapiens; identical to SEQ ID NO: 6666

SEQ ID NO: 6671 - DNA, 3874 bp, Homo sapiens
atgaccttttccctcccgcggctctctacctctcgccgcccctagggaggacaccatgggcccactgatggttcttttttgcctgctgttcctgtacccaggtctggcagactcggctccctcctgccctcagaacgtgaatatctcgggtggcaccttcaccctcagccatggctgggctcctgggagccttctcacctactcctgcccccagggcctgtacccatccccagcatcacggctgtgcaagagcagcggacagtggcagaccccaggagccacccggtctctgtctaaggcggtctgcaaacctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccaaccctactcttatgacttccctgaggacgtggcccctgccctgggcacttccttctcccacatgcttggggccaccaatcccacccagaagacaaaggatcatgaaaatggaactgggactaacacctatgcggccttaaacagtgtctatctcatgatgaacaaccaaatgcgactcctcggcatggaaacgatggcctggcaggaaatccgacatgccatcatccttctgacagatggaaagtccaatatgggtggctctcccaagacagctgttgaccatatcagagagatcctgaacatcaaccagaagaggaatgactatctggacatctatgccatcggggtgggcaagctggatgtggactggagagaactgaatgagctagggtccaagaaggatggtgagaggcatgccttcattctgcaggacacaaaggctctgcaccaggtctttgaacatatgctggatgtctccaagctcacagacaccatctgcggggtggggaacatgtcagcaaacgcctctgaccaggagaggacaccctggcatgtcactattaagcccaagagccaagagacctgccggggggccctcatctccgaccaatgggtcctgacagcagctcattgcttccgcgatggcaacgaccactccctgtggagggtcaatgtgggagaccccaaatcccagtggggcaaagaattccttattgagaaggcggtgatctccccagggtttgatgtctttgccaaaaagaaccagggaatcctggagttctatggtgatgacatagctctgctgaagctggcccagaaagtaaagatgtccacccatgccaggcccatctgccttccctgcacgatggaggccaatctggctctgcggagacctcaaggcagcacctgtagggaccatgagaatgaactgctgaacaaacagagtgttcctgctcattttgtcgccttgaatgggagcaaactgaacattaaccttaagatgggagtggagtggacaagctgtgccgaggttgtctcccaagaaaaaaccatgttccccaacttgacagatgtcagggaggtggtgacagaccagttcctatgcagtgggacccaggaggatgagagtccctgcaagggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggaca

SEQ ID NO: 6672 - DNA, 1155 bp, Homo sapiens
gtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctct

SEQ ID NO: 6673 - DNA, 1271 bp, Homo sapiens
atgctcataactgttaatgaaagcagattcaaagcaacaccaccaccactgaagtatttttagttatataagattggaactaccaagcatgtggctcctggtcagtgtaattctaatctcacggatatcctctgttgggggagaagcaacattttgtgattttccaaaaataaaccatggaattctatatgatgaagaaaaatataagccattttcccaggttcctacaggggaagttttctattactcctgtgaatataattttgtgtctccttcaaaatcattttggactcgcataacatgcacagaagaaggatggtcaccaacaccaaagtgtctcagactgtgtttctttccttttgtggaaaatggtcattctgaatcttcaggacaaacacatctggaaggtgatactgtgcaaattatttgcaacacaggatacagacttcaaaacaatgagaacaacatttcatgtgtagaacggggctggtccacccctcccaaatgcaggtccactgacacttcctgtgtgaatccgcccacagtacaaaatgctcatatactgtcgagacagatgagtaaatatccatctggtgagagagtacgttatgaatgtaggagcccttatgaaatgtttggggatgaagaagtgatgtgtttaaatggaaactggacagaaccacctcaatgcaaagattctacgggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttatttgagaacaggtgaatcagctgaatttgtgtgtaaacggggatatcgtctttcatcacgttctcacacattgcgaacaacatgttgggatgggaaactggagtatccaacttgtgcaaaaagatagaatcaatcataaaatgcacacctttattcagaactttagtattaaatcagttcttaatttcatttttaagtattgttttactcctttttattcatacgtaaaattttggattaatttgtgaaaatgtaattataagctgagaccggtggctctcttcttaaaagcaccatattaaaacttggaaaactaa

SEQ ID NO: 6674 - DNA, 1062 bp, Homo sapiens
cagttagtacactgaaattcaaagtcatgctcataactgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaa

SEQ ID NO: 6675 - DNA, 1036 bp, Homo sapiens
tgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaa

SEQ ID NO: 6676 - DNA, 1645 bp, Homo sapiens
gaaccacacttggtaactaataatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcaggatcaattacatgtttgcaaaatggatggtcagcacaaccaatttgcattaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctcaaaaatatattaaaacaaactaaattattgcttatgcttgtactaaaataataaaaactactcttatattggacttcttatcaatgaattagtaagtatagagacagacagctgaatggctttctgcatattgtatagtatacctagacatagaaacaaaatgactttagattttatttggggaagtaataataccataaaattagatattaaaattgtaagtgaagataaacacactatagtattcccttattgtagccatggtcctctagatgcagttaaccaaatagggtcatttttattaaaagtagtgtttcctggcaaacactgacattacatcattatcatgatttaaaggaaatagtactagagaaggtgaattattatcattttcctgt

SEQ ID NO: 6677 - DNA, 1462 bp, Homo sapiens
aatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcagaacatgctcaaaatcagatatagaaattgaaaatggattcatttccgaatcttcctctatttatattttaaataaagaaatacaatataaatgtaaaccaggatatgcaacagcagatggaaattcttcagatatggttttttgcatttcttattaagttttgcttcagatttttttttgtcttttctcctgttaattgccttcactctctttctgttctgtacttttctttgtatataaggattttttgaaaagattgtatatccctgttaacaaattgaaatctctattcactttaatagatttttacccccagttagcatatggttagtgagaagttgcagggtaagaagaaaacaatgttccctttcccaacacttttcctgattatagagaaaaaagcatgaacttgtataatgatctagtcctgtacagaatgagaaatattaattgctagactgagaatgttttggtggctaaagctaggaataactttttaagactgaagaatgatataagctatcaaatctaactcagttttcaaataacaggtttgcagagactggagaataaaaagtaaaaaattgttttattaattccagtgactaattctacttcatcaacatacatcataaataaaatttcaaaaataattgctgatatggtttggctgtgtcccacccaattttcaccttgaattatataatcaccatgcatcaaaggtagggccaggtggagataatggaatcatgggagcagtttccccataccccactcatggtagtaaatacatctcatgagatctaatggttttataaatgaaagttcccctggacaagttctcttgcctgccaccatgtaagatgtacctttgctactcattcaccttctgtcatgatggtgaggccttcccagcaatgtggaactgtgagtccattaaacctctttcctttataaatt

SEQ ID NO: 6678 - DNA, 1043 bp, Homo sapiens
aatgaaagatttcaaaccccaaacagtgcaactgaaacttttgtattagcatactactgagaatatctaacatgttgttactaatcaatgtcattctgaccttgtgggtttcctgtgctaatggacaagtgaaaccttgtgattttccagacattaaacatggaggtctatttcatgagaatatgcgtagaccatactttccagtagctgtaggaaaatattactcctattactgtgatgaacattttgagactccttcaggaagttactgggattacattcattgcacacaaaatgggtggtcaccagcagtaccatgtctcagaaaatgttattttccttatttggaaaatggatataatcaaaattatggaagaaagtttgtacagggtaactctacagaagttgcctgccatcctggctacggtcttccaaaagcgcagaccacagttacatgtacggagaaaggctggtctcctactcccagatgcatccgtgtcaattcttcagaaaagtgtgggcctcctccacctattagcaatggtgataccacctcctttctactaaaagtgtatgtgccacagtcaagagtcgagtaccaatgccagccctactatgaacttcagggttctaattatgtaacatgtagtaatggagagtggtcggaaccaccaagatgcatacatccatgtataataactgaagaaaacatgaataaaaataacataaagttaaaaggaagaagtgacagaaaatattatgcaaaaacaggggataccattgaatttatgtgtaaattgggatataatgcaaatacatcaattctatcatttcaagcagtgtgtcgggaagggatagtggaataccccagatgcgaataaggcagcattgttaccctaaatgtatgtccaacttccacttttccacttctcactcttatggtctcaaagcttgcaaagatagcttctgatattgttgtaatttctactttatttcaaagaaaattaatataatagtttcaatttgcaacttaatatattctc

SEQ ID NO: 6679 - DNA, 1292 bp, Homo sapiens
tgaaagatttcaaaccccaaacagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattgga

SEQ ID NO: 6680 - DNA, 2178 bp, Homo sapiens
aagtgaccttaaagccctagctttgtggtagtgcacttaaattcagaatcacacttggtaactaataatgaaagatttcaaaccccaaacagtgcaactgaaacttttgcattactatactactgagaatatctaacatgttgttactaatcaatgtcattctgaccttgtgggtttcctgtgctaatggacaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcattgcacacaagatggttggtcaccaacggtcccatgcctcagaacatgctcaaaatcagatgtagaaattgaaaatggattcatttctgaatcttcctctatttatattttaaatgaagaaacacaatataattgtaaaccaggatatgcaacagcagagggaaattcttcaggatcaattacatgtttgcaaaatggatggtcaacacaaccaatttgcattaaattttgtgatatgcctgtttttgagaattccagagccaagagtaatggcatgtggtttaagctccatgacacattggactatgaatgctatgatggatatgaaagcagttatggaaacaccacagattccatagtgtgtggtgaagatggctggtcccatttgccaacatgctataattcttcagaaaactgtgggcctcctccacctattagcaatggagataccacgtccttcccgcaaaaagtgtatctgccatggtcaagagtcgagtaccagtgccagtcctactatgaacttcagggttctaaatatgtaacatgtagtaatggagactggtcagaaccaccaagatgcatatcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggacttcctatcaatgaattagtaagtatagaaacagataactgaatggctttctgcatattgtacagtatacctagacatag

SEQ ID NO: 6681 - DNA, 1292 bp, Homo sapiens
tgaaagatttcaaaccccaaacagtgcaactgaaacttttgcattactatactactgagaatatctaacatgttgttactaatcaatgtcattctgaccttgtgggtttcctgtgctaatggacaagcaatgaaaccttgtgagtttccagaaattcaacatggacatctatattatgagaatacgcgtagaccatactttccagtagctacaggacaatcttactcctattactgtgaccaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtccaacttccacttctcactcttatggtctcaaagcttgcaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattgga

SEQ ID NO: 6682 - DNA, 1066 bp, Homo sapiens
cagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttactcctattactgtgaccaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccatttcccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatg

SEQ ID NO: 6683 - DNA, 2157 bp, Homo sapiens
tctttaatgggaaggccattttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataattctcaaataaatattttggtgaagcat

SEQ ID NO: 6684 - DNA, 2053 bp, Homo sapiens
ggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagcagctagacatcctacaattcaaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataattctcaaataaatattttggtgaagcat

SEQ ID NO: 6685 - DNA, 1914 bp, Homo sapiens
cgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataa

SEQ ID NO: 6686 - DNA, 963 bp, Homo sapiens
caggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcagcatttgcagaactatgcatagaagaaacagaaattttgactgctgacatggatgcagaaagaagacggataaaatcattattacctaaactatcttgtggagttaaaaacagaatgcacattcgaaggaaacga

SEQ ID NO: 6687 - DNA, 1218 bp, Homo sapiens
aaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtgactcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggaaaaatgaagcaaatctcactggatatttttaaaggtctccacagagtttatgccatattggaattttgttgtataattctcaaataaatattttggtgaagc

SEQ ID NO: 6688 - DNA, 2181 bp, Homo sapiens
gtcacgctcggacgcgggcggggggcggggagcgcctgcgagtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccgcgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacggggggctgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttca

SEQ ID NO: 6689 - DNA, 5023 bp, Homo sapiens
ggggttggcaacagagcaggtaggtagacctgcatttggttgctggtcacagaaatggagagtgagagatatttctaagtcaggatgccctagtggcagacccccaagtcctcgaacttcagggcagaactgcctgggtgggaactctcccatgtctccttgatttcactgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggaaggtgtggtccctgccatgctatctgctctgctcagcgactgaaggtgcccgcatcccagctctgccaggaagcaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgtctctttgtgtctgttatcctgggcaggatggtcattctcaaaaaccctggggtcctgggccagagacaggcagggcccagtccaggggccccaggcctccccagtcccagtgtgcgagccccacttggacacaagtgttcagagaggtccccctctgccacttgacagggaccttcaaacctcgacagtgatgcaaggacacagagagtaccagataggtagcagagaccaaggcgcagggtgcttcagatgagcaagagaacccagtcgaaccagataccccaggtgggccggagggaccccagaccttcagagggctgccctggtgttctccacagtgcagtccctctgtattcccagagtgggatcggggctttcagccccaccctgatgcctgccctccaggatggctggtttagtctgggtccatgtcccagacccctctattctgctccaggacagcaggacttcaggtcttcctgggggtggatataggagaaaatttctgcctggcacacacctggctccaaccactgccaagtgatcactcttaggcccaggggaacacaatgactatcattactgatgcagacctggctgtggagagcagctaatgtgtggcccagagagcctgtctgtgtggagcacgtagtgcacagaatacgtgagagttgctctggcaggggcagaatcctcacaggatcgcctgggaggtgaggtgtgtgtgacccactggatgggagggcaatgagtgtgcacatacaaatggggcagtgtgcatgcaacacacttaggggaggagtggccccagaattcagcacgcacacaacacacaagggagagaacccccagatgagaaaataggaaggagcaatcatttgtagatgggtgaaaaaagaatgaggttcaagggagcgtgcaccaggtgaggtgagcgtgtgtgctctcagggaagggcccaggatcccatgcctgggaggagctgccagagagaagcaaaaaggcggctgtggatcgccctgggctgggcaccagtgacaggtcaggatctccaaacatggacgtcctcccctccaaatccagaagctcccagaaggtgtccttaactgcaaagctgtgcagggtactcctccagatggaatcaggaagtcgagacaccatcccaggtgtgtgtaagagagagagagagaacagggaggatacagaagtattgcagcccagatcccctatcagggggacagctggtgggcaaagcagccaccccacagccttgtggctagagtacagtggggtagaccctccagccccaatagccctagtacccagctggcagggttgcccacccctgctgtccacctgctccatcctctagggttccacaggcccctgaccgcacagggaggctggggccagcctggtctcccaggcctgaggacatgcctcccaccaaatgtcccctgctccagtcccactcctgtcaccccacgctctgcactggggagaaaacgggaggtgctcgtgctggccctgggtgggagcggggagtcctggtgagaccccggtgagatggaccatcctgcccccgtgggggatcccctttcccacatccgtgctgtgtcattgttgctctgcttcctttcaatgtgtcagtgcctggggggaggggaggagcaccccctcagcccccctgaacctgaccaaaagccatggctgttgctcccccctttgtatgatgcaaatgctgaaatgtacaaaatcaaccatgacaacaaagaaaaagaccttgtacagc

SEQ ID NO: 6690 - DNA, 826 bp, Homo sapiens
catctggaaggggagcggtagaacgtcagggcccggctgaggggcgtgattggagggcgccttcggcagccgcccgcggcagaagccgcggctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccct

SEQ ID NO: 6691 - DNA, 1455 bp, Homo sapiens
gcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtcccca

SEQ ID NO: 6692 - DNA, 532 bp, Homo sapiens
agacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaa

SEQ ID NO: 6693 - DNA, 557 bp, Homo sapiens
agctggaggcggggagagccttgatcaaagtcaggcaggggagcacagcggcttcctgacgctggacccaggtggggacagagcggccctgtgaagtcaaagagaatgttgctttgttcagctctcactgggaaaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggag

SEQ ID NO: 6694 - DNA, 970 bp, Homo sapiens
agtggctcagacggttgcagggaccgccaggtcggtgctggccgagggccgggagggcggagctgggctgtgggcaacagggtcccggctctcgcctcgaggccttggggcagctcgggaagctggggagcacggctttcggggggacagctccccaaggctgcctgggcaccggatggggactgagaggcggtaaaggggacactcccgggtgcgctctccgtggtgctgaaaggacagctccttgcgaggggccgcgagcaggcagctagctgcgaactaagaggaagcgtgggccctagccggagactccgggcagagcccgaacggccggggtcccggagccaggaccgccccggctgcggcggagactcaagtctgaacccagagaacaactttgagctcgcgggagtgggggacgtcgatctaagctacttctggctgtgcttaacccgaagcccgccggagcacgcttcgccccggaggagggagtcgcccccaggggtacagtgcgcactcccggagttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacgg

SEQ ID NO: 6695 - DNA, 567 bp, Homo sapiens
aatctccgccggagccggggaaaggtggcattgccatttctctcttagagaggaggaaactggggactcgagcaggttagggccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggca

SEQ ID NO: 6696 - DNA, 576 bp, Homo sapiens
aatctccgccggagccggggaaaggtggcattgccatttctctcttagagaggaggaaactggggactcgagcaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcct

SEQ ID NO: 6697 - DNA, 469 bp, Homo sapiens
cgggcgccctcgtcggccgcggaggagctgcagcctccaacagaagggaaaacggacacctgtggaggggaagaaacgtgtccaagatcattcacacagagcgtcagctctggggtcagaacccagctcccaaggctttccgtgtccagaccacctccctcacctggttggccagcctccacctgatgagccgggcaggctgcaagtggcaagttccctgggaaggtgtggtccctgccatgctatctgctctgctcagcgactgaaggtgcccgcatcccagctctgccaggaagcaaagttacagatgagaaaactgaagctcagagagtgaaaggacttgcctaaagacacacagctggttgtcacatcttcccaagccaggccagccaggagcgctgcatgcaaattctgccgtgggctaaggcacgctaaccagagccggcggcatggacttcgtcatgaagca

SEQ ID NO: 6698 - DNA, 3035 bp, Homo sapiens
ggcgtaggtagatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttctaaa

SEQ ID NO: 6699 - DNA, 3369 bp, Homo sapiens
gcggctgcgcctgcgccaacgccgtcagtccgcggggcccgatcccgacacctaactccacagagaagctctgctcctaagggaaagggaagacttcagccacagtttcgcagccaacctggcgacctcacctctctggcgacctcacttcccagccggctccgtttaagaaaaccccgcgcaggaccgcgcccgcccccgccccctcgcgcccgccccctcgggtaacaaacatggcccccggcggggcggaagcgcttccgcccccaacgaagatggcggagggggcgggactaaaagggcgtaggtagatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatccgggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcagtacgatgccaactgttaagcctgcaggaatcctcctgggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttc

SEQ ID NO: 6700 - DNA, 2843 bp, Homo sapiens
ctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccca

SEQ ID NO: 6701 - DNA, 2921 bp, Homo sapiens
agcggacccccctgtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccca

SEQ ID NO: 6702 - DNA, 2963 bp, Homo sapiens
gcacttcgcaatgagtcttttggcgtcaggtttggcgggtgcagcctggagaaagcacttctgtaaaatcgtgcgtgttacatggaaaggcctgaaagttctgggcaagtggttttgagctgcatgtcaaagccactgttacccgttcctgttaccatgcagtgcagtcagattgccagtccccttgtcggaaagaagcttgtggaccggggccttggagctcattaagtgaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatttgaaactttctactatagtttacagaacaaattattttatttttattgtaaatcttagtgtggaagagctgatttctaaaatatgattaaagtaaatatatacctatgaatatcaagagtcgtctccctgagcctgtagttggaagtgacgactgtaatggaatgatgtcttgtatagaaatgcccttctctgaaataaagagaactcctgggctttctaaagaggctgcgggaagccatcctccactcccactgtgtgtgagagcagtgcttctgatcctgctgtcaccccgacctctggcaggagccggcgccagtaggaaagacctccttcctaaataaaagaagtgtctccc

SEQ ID NO: 6703 - DNA, 2784 bp, Homo sapiens
gtgccgtggaaactggcggtggccgcggccgccgagtcggtctgcgcagcctcctgcgttttctcgcttggatcttggcactgagaggcggtggccggcgggatggagaaaagtaggatgaacctgcccaaggggccggacacgctctgcttcgacaaggacgagttcatgaaggaagatttcgatgtcgatcattttgtgtctgactgtaggaagcgggtccagctggaagaactgagagatgacctggagctctactataaacttcttaaaacagccatggtcgaactcatcaacaaggattatgcagattttgtcaatctttcaacaaacttggttggcatggacaaagccctcaaccagctttctgtgcctttgggacaattacgagaagaggttctgataatgtctgctgtgagttgggactccccatgtctaagccattggagacagggactccatccggatgaacagtagagaagggagttttggcatcattttcaacagaaaagtgtgctaccctgtcctgtccctgctggtccaccccacagtctgtgtcaggcaccccgacttccatgctgtcttaggattgatgaactgtcataaacttcgttgattgcaccattattacctgtagccttagatcgtctgtcagtgaaggaattcgggcagttgatgaacgaatgtctaaacaagaggacattaggaaaaaaaagatgtgtgtattgaggcttatacaagttattcggtcagttgagaaaattgaaaaaatcttaaactctcaaagttctaaagaaacctctgcactagaagcaagcagcccccttttgactggacaaattttggagagaattgccacagaatttaatcagttacagtttcatgctgttcaaagcaaaggcatgcctcttttggacaaagtaagaccgcgtatagctggcattacagccatgttacagcagtcactggaaggtctcctattagaaggccttcagacgtctgacgtcgatataatacggcactgcttgcggacttacgccacgattgacaagacacgggacgcggaggccttagttggccaagtactagtgaaaccatacatagacgaggtgattatagagcagtttgttgaatctcatcccaatggccttcaggtcatgtataataaactcctggagtttgttcctcaccattgccgccttcttcgagaagtcacaggaggtgccatctccagtgaaaaaggcaatactgttcctggatatgactttttggtgaattctgtttggccacaaatagtacaaggattagaagaaaagttaccctcgctttttaatcctgggaatcccgatgcatttcatgagaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctgaaggggagaaagtgactctgttctcttagcaaccgtctgtagcaaagaagtgcttccagcatcactccagcaacacgcccatgcgtcttctctcagcgtatttgggtcttctttgcccaaaagaacacaaaagcctttttccattgtatggaagatagtttttaagacatt

SEQ ID NO: 6704 - DNA, 1400 bp, Homo sapiens
agaacatgagcactgccatttaaagagcaccagacttagagtgcctgggtctcagatgggctttgccatggaagacacggaagacatatcacagaaccactttgggcatttatgtatctttaaatggggacattggaagaaagatcttaaatataccataagtatggattttgtcagaagattggaacggcagtgtggatcacaggctagtgtaaagagattaagagcccatcctgcctatcacagcttcaataagaagtggaacttgcctgtttattttcaaataagatttagagaaatagcgggatccttagaagcagcacttacagatgtcctggaagatgccccagctgaaagtccgtattgccttttggcttctcatagaacttggagcagccttaggaggtgttggtcagatgagatgttcttgccattactggtgcatcgcctgtggagactcactctgcagattttggcacgatactctgtgtttgtcaatgagctttcactcaggcccatttctaatgaaagtcccaaggagatcaagaaacctttggtaactggtagcaaagaaccttccatcacccaaggaaacactgaagaccaaggaagtggtccttcggaaacaaagcctgtggtttccatttcccgcactcagctcgtgtatgtggttgcagacctggacaagcttcaggagcagcttccagaactcttggaaataatcaagccaaaacttgaaatgattggctttaagaatttttcttctatctcagcagccctggaggactcccagagctctttttcagcctgtgtgccctccttgagtagcaagatcatccaggatttaagtgactcttgcttcggtttcctaaaaagcgccctggaggttcccaggctttaccgaagaaccaataaggaggtcccaaccacagcttcctcctatgtggacagtgctctgaagcccttattccagcttcagagcggacacaaggataagctcaaacaagcaataattcagcagtggctagaaggcactctcagtgaaagcactcataagtactatgaaaccgtgtcagatgtattaaactctgtgaagaagatggaagagagcctgaaaaggctgaaacaagccagaaaaaccactcccgccaaccccgtcggtcccagtggtggcatgagcgacgacgacaaaatcaggctgcagttggccctagatgttgagtacttgggagagcagatacaaaagttgggactacaagcaagtgacataaaaagcttctcagctctcgcagagcttgttgctgctgccaaggaccaggcaacagcagagcagccttaagcatcttggaagatcccgaggttagattcttaagcaagagaagagttggacttccaggctg

SEQ ID NO: 6705 - DNA, 4498 bp, Homo sapiens
gccccgccgccggtgcagtgttggaagctccggttctcccggaagtggcccaggtctctctgtcggggtcccctccatctcgctgctgctgaaggccgcgagggcggcggcgatggcggaggcggcgctgttgctgctgcctgaggcggcggcggagcgggacgctagggaaaagctggctctctgggatcggagaccggacacgacggcgccgctgaccgacaggcagacggactcggtattggagctgaaggcggcggcagagaacttgccggtgccagctgagcttccaattgaagacttgtgcagtttaacatcccagtcactgcccattgaactgacttcagtagtgcctgaatctacagaagacattctcttgaagggcttcacttccttaggaatggaagaagaaagaattgaaaccgcacagcagtttttctcatggtttgcaaagctgcaaactcagatggatcaagatgaaggaactaaatatagacagatgagggattacttgtctgggtttcaggagcagtgtgatgctatattgaatgatgtaaacagtgctcttcagcatctggagtctttgcagaaacagtatctttttgtgtccaataagacaggaaccctacatgaagcctgtgaacagctcctaaaagaacagtcggaacttgttgatctggctgaaaacattcaacaaaagctttcctattttaacgaattggaaactattaacacaaaattgaattcccctacattgtcggtgaatagtgacggatttatacctatgctggccaagttagatgattgtataacatatatctcatctcatcctaattttaaagattatcccatatatttgctgaagtttaaacagtgtctttctaaagctttgcacctcatgaagacatatactgtgaacacactacagaccctcacaagtcagttactgaaaagggatccttcatctgtacctaatgcagacaatgccttcacattattttatgtgaaatttcgagctgctgcccccaaagtcagaactcttattgaacaaatagaactgcggtctgaaaaaatacctgaataccaacaactgctaaatgatatccaccagtgttaccttgatcagcgggagctccttttgggccctagtattgcttgcactgttgcagagttaaccagccaaaataatagagatcactgtgccttggttcgtagtggctgtgccttcatggttcatgtctgccaggatgaacaccaactttacaatgaatttttcacaaaaccaacatcaaaattagatgagcttttggagaaactgtgtgtgtcattgtatgatgtcttcaggccattgatcattcatgttattcacttagagactctgtcggaactttgtgggattcttaaaaatgaggtgcttgaagatcatgtgcagaacaatgctgagcaactgggggcatttgcagctggagtcaagcagatgttagaagatgtacaggagcggctcgtctaccgaacccacatctatattcagacggacatcacgggctataaaccagctcctggagatctggcatatcccgataagttagtcatgatggagcagattgcacagagtttgaaagatgaacagaagaaggtaccttcagaagcttcattttcagatgttcacttagaagaaggagagtctaacagtctgacaaaatctggttcaacagaatccctcaatcctagaccacagaccacaatttctccagcagatcttcatggaatgtggtatcctacggttcgaagaactcttgtctgtctctccaaattatacagatgcatagatagggcagtgttccaaggattatcacaggaagcattgtctgcctgcattcagtccttacttggagcgtcagagtctatcagcaaaaacaagactcagattgatggacaacttttcttaattaagcaccttttgatacttcgtgaacaaattgctccatttcacactgaattcaccattaaggaaatttccctggacctcaagaaaactagagatgcagcatttaaaatcctgaaccctatgactgtcccaagattttttaggctgaatagcaacaatgccttgatagagttcttgttggagggtactcctgagataagagaacattatcttgactctaaaaaagacgtagaccgtcatctgaaatcggcctgtgagcagtttattcagcagcagaccaagctgtttgtagaacagctggaggagttcatgacaaaggtttcagcgttaaaaacaatggccagtcagggaggccccaagtatactctctcacagcagccttgggcacaaccagcaaaggtcaatgaccttgcggcaactgcatataagacaataaaaacaaagctgcctgtgacattgagaagtatgtccttgtacctatccaataaagataccgagttcatcttgtttaaacctgtgaggaataatattcagcaagtcttccagaagttccacgctctgttaaaggaagagttcagccctgaagacatccagatcattgcctgtccatctatggaacagctgagccttctgctgttggtttctaaataagcaggccagccgggctgtgcacctaaatgtctgtctgggaggagcaggctgagaagtcttgcagtctgcaggacaccgaggaatcgtatgtgggaacgtccccgagaaccacacgagcgtgctgctcagtgctgactgcagaatgaaatagaagcaaagtgttacaggatcagtgttttcttttctaaaacatcaaaatgccaaagattaatctgtgattggtgataactgcctcgtttaaatggtcacaagaaatgtgaagagagagctagggcagacatgcagtgaaatggttctttgttaaaaatgtgcaataaaaatagattacaataagtagtgcaaagaactttacagaaatcaagcgaattagaaggcctgtaagagtaaggtttgctaaaacgtgaaacactgtaacacttttaaccactgagcattccacagtgaaatgttatttctatgctcttatttaatgtaatgtttctcctgtcatttttgaagttgagtttggagtagattggttgcttctgagaacacattctgccttcctgggaagtcggggtgtcatcctttcctctgtttgatgtgaggtagtttaaagatacaaggactttgtgtgaagctccagcatctgtgccccttgaattgcttaggtgcagacagttctaaagcaaggagctgcagcattctcatcatagatacgtgcagtatctttaatgagtatcttcatggtatgatagtgtgtgtttgtgagtgcgaagtaccaattaaggtgtcttaaatttggcgcatagaggagagaaggaaacctgaggagtagtgttcctcctgaatgaaggttcaggtcaccagccttctgtacactgcctttggttttagcagttctttgaaaagcaaacactttcatgtcctgtctattcattcagctggctgtgctgtgctgtggaccagctgtgtggatctctagcccagctacagcagaatacattttaccagcaaacctaaggatgacaaacactatccacatctgaaaactaccacaccatatcagggatcataaattatgcatatctatgaattttccaacaaattcctacttcctgattggattggttttgccgctgatgttaaggcagccagcttcttagttcaaaaagaattctgagtttttcaaacactagtctagaggtggacattgtcaggggttctggaatgggaccaggggaccttttggtgcagtgggtgcctgtaactcattagacgtactgaggcagcacttctgcagggtgcataccctgattgttgtcatttgtaacaggtcacttccttttcactcagtttaaattggtgatggacgttgcttgattgagcttattactctctattttgagaaggtagaaggtaagagggcccatattcattctttgccatgaaatgaatgaattaggaagattgtatttacttaactgttttttaaatacatgtttaatgaaataaactgtaaaatatccagttttgtgtattatatgtacatttgatttttaatagcctttccaaagaaatgagggcatgattattgtacagtaagtacgtgactgatttaatttgatttacagagcggagtgtgttcttataaaaatatttaatgacattggttcttgtcttttgatcttttatttctgaaacactcaaacaccttacaaagtgctgagtaggtaatagtgacccaacttgtttgctaaatgattatttgtttaaatctgtacagttttaagtgttcacttatacaaagagtgtatatactttcaaataatttaaaatgctttatattatttggctagaaattgctgtttttaataaatgtgaattttttaaaaataaagatttttgcttcctaccttg

SEQ ID NO: 6706 - DNA, 2833 bp, Homo sapiens
ctcgcgggaccggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttggagaga

SEQ ID NO: 6707 - DNA, 2734 bp, Homo sapiens
aagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctgagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgtttatgatccctgaataaagctactccttgg

SEQ ID NO: 6708 - DNA, 1017 bp, Homo sapiens
aagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagaggggagcatgattgatgccaacctgaaattgctgcaggaagctgagcaacgtctcaaagccattgtggcagagaagtttgccattgccaccaaggaaggtgatctgccccaggtggagcgcttcttcaagatcttcccactgctgggtttgcatgaggagggattaagaaagttctcggagtacctttgcaagcaggtggccagtaaagctgaggagaatctgctcatggtgctggggacagacatgagtgatcggagagctgcagtcatctttgcagatacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagaactttgttttttccttcttttga

SEQ ID NO: 6709 - DNA, 2225 bp, Homo sapiens
aagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggagaaagtggtggagagagagctggatgctcttttggaacagcaaaacaccattgaaagtaagatggtcactctccaccgaatgggtcctaatctgcagctgattgagggagatgcaaagcagctggctggaatgatcacctttacctgcaacctggctgagaatgtgtccagcaaagttcgtcagcttgacctggccaagacacttactcttctgtttgaagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcagttccggcatgttcagaacaacctgatgagaaattctacaacagaaaaaatcgaaccaagagaactggaccccatcctgactgaggtcaccctgatgaatgcccgcagtgagctatacttacgcttcctcaagaagaggattagctctgattttgaggtgggagactccatggcctcagaggaagtaaagcaagagcaccagaagtgtctggacaaactcctcaataactgccttttgagctgtaccatgcaggagctaattggcttatatgttaccatggaggagtacttcatgagggagactgtcaataaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcagggatgttctgtgtaataagctgcggatgggctttcctgccaccaccttccaggacatccagcgcggggtgacaagtgccgtgaacatcatgcacagcagcctccagcaaggcaaatttgacacaaaaggcatcgagagtactgacgaggcgaagatgtccttcctggtgactctgaacaacgtggaagtctgcagtgaaaacatctccactctgaagaagacactggagagtgactgcaccaagctcttcagccagggcattggaggggagcaggcccaggccaagtttgacagctgcctttctgacttggccgccgtgtccaacaaattccgagacctcttgcaggaagggctgacggagctcaacagcacagccatcaagccacaggtgcagccttggatcaacagctttttctccgtctcccacaacatcgaggaggaagaattcaatgactatgaggccaacgacccttgggtacaacagttcatccttaacctggagcagcaaatggcagagttcaaggccagcctgtccccggtcatctacgacagcctaaccggcctcatgactagccttgttgccgtcgagttggagaaagtggtgctgaaatccacctttaaccggctgggtggtctgcagtttgacaaggagctgaggtcgctcattgcctaccttaccacggtgaccacctggaccatccgagacaagtttgcccggctctcccagatggccaccatcctcaatctggagcgggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctct

SEQ ID NO: 6710 - DNA, 4060 bp, Homo sapiens
attggtccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgctctgctctcctgccttacgccgcgcggcccctgttctgaggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagcc

SEQ ID NO: 6711 - DNA, 4343 bp, Homo sapiens
gcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggggagccctggaagcttatgttcaatcagtgagaagtagagaaggcaaagaatttgcaccagtttatcccataatggttcagctgcttcaaaaggctatgtctgctcttcagtaatgacatgaaatctttgttcatctccactttgtgctaacccattcatagttggcagttaaacacatactccaaaagactgctactatctactattttaagaatgtaattgattgttcggtatttcctatcgacgtttatttacctctttagcacttatactttagcataaaaaatgttgagttatcaccacctttcaattccatggacctgatttttccagaaagatgttttcctctttcagatttttgtacaaggctaaaatgtctttcccatccataaccaagtcctcctatgggtacataaacccaaagtccccacttcttttaaagggatatgatcaagttataacatgtaccctgcttcccccaaccctgccttcttcactaaataagcatgtagctcagtggtttccaaatttggctgcacattcataccaatcaccaggggatttttttaaaatcctgatgcccaacttgcactccacattaattaacatgtctaggagtgggagcctgacagacaccactattaaaaaaaaaaaaaatccccaaaatgattccaatagacaacaaagttgaggaaccactggcacatcccaagctaagatacaaggttaaatggcctttttaagtatgtcatactggatctttaaataaagcaaggcttttgttacactttgtcatgttattaaaagcagacctttgggctgtttaaccgtgtaacaaaaatgccacgtgaaaaataaaaatttttattgtatagcaattctctataaatagtagataatctaagtccttattttctgatggctcttgttccactattaacattgtttttaatttttaaaatcctatcagcagcctcctaattagcagtgttaggaatttgccttatgttttccatctcatctcctgaacctgttattctgagaactcataaataaaattcagccaagattaatcaatcaatcaatcaatcagtagacgtcagagataagcaacttttttttccatttatttgaaataatatacaagaatatagtgtgcaaaatttaggggcaacatcatgaagaagtgtgatgaactgaaatcaattttacagctgtgattcctaaccagaaacaccacttggtaagtaacatgaaaagccatgattgtagctcagagcaaaagcagctgtattgccaatgtatttgctctaattttagacagttggaggaaaattaaagtgcaagtgttgcactgcagtaagtgcaaagtctgcccccaccataaagattatgatgacaaaatatatttaagatacatggctgaggagatacagaacacgaagttaaaaaatacaatggtgttgactgtttgttaatagcaccattacagtgactatatcccaatgctattaactaactttaccttggcctgggctaggtctccattggaaataataacggatggctgctgccacctggtgcatcaactcagcatgccatggtaactgcagcaggtggctcttaggctgggacaccaacaccagccacctgccccatgttctggtagcctcttggcactgaccagactaggagcgcctatgtttggcacagatgctgagccatgtggtggttactagaggaaaggccgactcccagcttctgcttcatttcatcatgtgtacaatacagattaataagcagtaaggagccaatgtataaacagcagttacatattttttaaattcccctttcgtacaatttaaaataaaacatgtatacactt

SEQ ID NO: 6712 - DNA, 5418 bp, Homo sapiens
ggtttaatacttgcttcacagataagcgctgcggccacgttccggtgcccaccttctccttggctagggcacgacgccagcccagggggcgcggccctgagctgctgcgagagacagctgaaagcgccggcccgacggccttggctccctcggtgcgctgggcgcagagcactcggaccctgggcgcccactgctcgagtacctgcgcggctcctagccaggcttagcccaggcgcgggctgagagtcagttcgccaggtgggcctggagccatgggctgggtgggcgggcggcgccgggattctgcgtcaccacctgggcggagccgttctgctgctgacgacatcaacccggcacctgccaacatggaaggtggcggcggcagcgtcgctgtagctggcctcggagctcgaggctctggagcggctgcagctacagtccgggaacttctgcaggacgggtgttatagtgactttttaaacgaagactttgatgtaaagacttatacttctcaatctattcatcaagctgtaattgctgaacaactagcaaaacttgcccaaggaatcagtcagttggacagagaactacacttacaggttgttgcaagacatgaagatttactggcacaagcaactgggattgagtcgttggaaggtgttcttcagatgatgcagacgagaattggggctttacagggagctgttgataggataaaagcaaaaattgttgaaccatacaataagatagttgcccggactgcacaactagcaagacttcaggttgcctgtgatttgcttcggaggattattcgtatcttgaatctcagtaagagactccaaggacaactgcaagggggaagtagagagataacaaaagctgctcagagtctcaatgaacttgattatctttctcaaggaatagatctttctggaatagaagtgatagaaaatgatctactttttattgcaagagcccgacttgaagtggaaaatcaagctaagcgcctactagagcagggtttggagactcagaatccaactcaagtcggaacagctcttcaggttttctataatcttggaactttgaaggatactattaccagtgttgtggatggatattgtgctactttagaagaaaatatcaacagtgcattagacataaaagttttgactcagccttcccagtcagctgtgagagggggacctggacgatctaccatgccaaccccaggaaatactgcagctttgcgtgcctcattctggaccaatatggagaaacttatggatcatatttatgctgtttgtggacaggtacaacatctacaaaaagtattggccaagaagagagatcctgtttctcacatttgtttcattgaagaaatagttaaggatggacaaccggaaattttctacacattttggaattcagttactcaggcactttcttctcaatttcatatggcaacaaactcttcgatgtttttgaagcaggcatttgaaggagaataccctaaattattacgtctttataatgacttatggaagcgtcttcaacaatacagtcagcatatccaagggaattttaatgcaagtggaactacagacctctatgttgacctacaacacatggaagatgatgcacaagatatattcataccaaaaaagccagattatgatccagaaaaggctttgaaagactcactacaaccctatgaggctgcttatctatcaaaatccttatctcgactcttcgatcctatcaacttggtttttcccccgggtggtcgtaatcctccttcctctgatgaacttgatggtattattaaaactatagcaagtgaactaaatgttgctgctgttgatacaaacctcacattagctgtgtcaaaaaatgtggcaaagaccatccagttatacagtgtaaaatcagagcagcttctctccacacaaggagatgcaagtcaggtgattgggcctcttactgaaggacagagaagaaatgtggcagtagtgaattcattgtataagttgcaccaatcagtaacaaaggttgtttccagtcagagctcattcccactggcagctgagcaaactataatttcagctctaaaggctattcatgctcttatggaaaatgctgtgcaacccttactcacttctgtgggagatgctatagaggccataatcatcaccatgcatcaagaagacttttctgggtcattatccagctcaggaaaacctgatgttccttgttctctgtacatgaaggagctacaaggtttcattgccagagttatgagtgactattttaaacactttgaatgcttggattttgtctttgacaacactgaggctattgcccaaagagctgttgaactttttatccgccatgccagtctcataagacctcttggtgaaggtgggaaaatgcgacttgctgctgattttgcacagatggagttggctgtgggtccattctgtagacgagtatctgatttaggaaagtcctatcggatgctgagatcattcagacctctgctcttccaggcaagtgaacatgtagccagtagtcctgcattgggggatgtgattccgttcagcatcattattcagtttttgttcacgagagcacccgctgaactgaaatctcctttccagagggcagagtggtcccacacacgcttctctcagtggctggatgaccatccatctgaaaaggacaggctcctcctcatcaggtaaagccaggtgctctgggggcacccatctggtctggaagcccaaggagggtggggatgcaagagaggatgaaggagcagtgcctgggggcatggacatgtgactgcaccttccagtggcgggccacctcactgcctaggcacgggtgctggagcaaccagcagttggaaatgttggccacaacatcttttgctttctttcattccaaaccttcatatccctgatgtgcaatcctgtgtcccatgcaaccctaaggaccatgcatttgtacctttgaaaatcatcatttgctatgaaaagttttgccctagctccgcatcttttacttcatttttatgtgctgcagttactgaattggtggaacacagatgtgagtgaatttttaaaaatacccaagtgcgaaacagttctgaggaggaaacaagaacaacccagcagccacttggataccatggccctccagtagtgccccatgaatgcattcacatacatacgcatgtgctcttgcccacacgtgcacacacccccatgtaccccaaccatgcccagggtggggtgctttaactgtcatacatggcttattaagcaacactcttccctgcaactgctctcaccatcaccagagacctctcagccaccaaacattcccatttttaccttaccactctgtagctttagctacagttgaccgccatttccttctgtaaactcataaactgggactcagcacatttttattgatgctgagctcacattttatcagcatggtaggccctgggccaggaaccgaggatacgaagtaagccgagatatggccctgtcctctcagagcttgcattacaccacagccatctgtttctgttctaacttctctggccatttttttttgtgtgtcatttgctgaattatcttcttctagccattccttaaatgctatcatttcccatattttcttcttctcatcctgcctctgccttggttcccaggtgagcttgtccagacccatgcctctagtgccccttctatacttaagagccctcaggtctgtgactgcctctggatggggccttggcccagtaaacttgctatcatatgtcaccacccacagaaatctcaaccccagaatggtcaaaataattctaatcttttctctcaaaccttctcattctcttatactccctgtcttggttgggaggtcacaatcacctaactagccaagccggaaaacctttacatcatcattcaactcctctgtcatccttattcctcaaacccactctgttgcgtctctaaaatagctcttgaagtcattctcaactctcccaggggatcccaattctgttggtctgggcccactgcacccagtgatcctttgttagcctgtgtcaggtgatgagttgagttccctaaagccagagtggggctgacatgatgaggtggttctaaaccacatgtgcacacaagaatcatttacatagcttggaaaattcctagtgcccaggtctctcacccttgcctacctcagaatctccagggtaggcctgctatcaggatttctctatagctccccaagaaggtccagggtgcagccaagggcgtgaacccctgccatagtgggtcatatttcagttaggatgaaagactgctgaggaagctatgacaggtcagtaagaaccatcagcctgtcagctttgtttccagaagtgaccctgagccctcaagcttggtacccacatcccacatgagccactggccctctgggcgtatgtgtggataaagattagctcggaccctgctctttttccttgcttatctgttactcagctatgaacatctgacacagaaatgggagaggttaccagccccggtgaatgttcctggtaaaatctgccctcgggaaaggctttggatttgggtgaggagtttgggcctgggctaacacagggatttgcaatgtctgtgtggattatttttcccgagtcccaaagattcactcagctgcaacacactcagtcgtcttaaaaagaggattcagttaattgaacacgttcatttttctcatcttaacaagttggtcatttttgtcgtcttaacaagttggaatgagttcatccaaaacagttgtcctgctgtgtgtacatcacaaatctgttttcttttgcttctctttaaaaatgtctcctgagtgatttcatcagcagtgctgttgctaagcctatatttagcaactgaaaatcatgctcagaaatactgtcatgcttttttaaaaaggcatatccatccctccacacatggctgattccagaaccttcatgcccttagcaaaaaattgagctgtccttcagggtttcaaaaaaagtactgtactcctgctgcaccccaggctcttggcaaggaggggacttttgtcctagagaatgttctttcttatgtattattgcaaaacaattttgttcttgcatactgaagcatcactggatgaatttctttcccctgtagacaaaccgagggtgagtattgctctttaaatgtcagtaaatttgttttagcttctggggcaaaccttgttgtatactcattctgttcctcccagcataatatgttaggttgtcataaaatagggcaaattgaggatagtgtaactactgctgctgaataaatgggaaatagtgaacca

SEQ ID NO: 6713 - DNA, 3609 bp, Homo sapiens
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatt

SEQ ID NO: 6714 - DNA, 5257 bp, Homo sapiens
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaagcgtccacccaacggcccatgatcatcttgtaaccagtgcaggaccttgtgcttctggagccattccagttgtgggaggtgatgtctcggaaaactctgccttggggactggctatagaaatgtggccagatggctttgtcatcttcccctgtctactctgtgactcttcatctggtggaaatgctgtgagggatgaaccaaatggaaactcagatttactcttcagaataatgcggatcataatacgcacacacacagcatgtagagttgctgtgtggcttaaataagtaaatgtatgcaaagcactaaaatggtgtctgtctaagtgtaaacaccaattgtgttggctattatcactattgttgttcttatctcaaatatgtgttactttctaaataactttagtgttcatagattgttaaaagacaagatgacctgaagaaaagtaagccctaaaaatccattattaacttttttctccaccactcttttcttctaaacttcactattctttgtgttttcacaaaagttgcttacttcacctggcagagatagcattacgcaggggatgattaaaatatactcacttgtacttgttggttttaaattttattatttatgaataggtaatagcatgtacactgtaaaaatctcaaaaggcaaaaaaggatatacagtaaacattaagttcctcttaccctggaccttagccatcaagttctcttccccataggcaatccctgttgcctaatttccaattcccctgcatactttaaagatcatctgtgcatctgcactcagaccactcacacgtctaaaacaaatgatagcacactacacacaaagttctgttcctttttatgctcaatgatatgttttgcatcatatttcactgccgtataaataatgctgcctcgatttttaaaataactgaacagtaatacacagtatgaatttactccaatttataatccaatccttagttaatggatattttgattttgttgttaagaatcatgcagcaatgatgtacctgttagacatgagttattaatttctcttcgaagaatcaatatgtcactacgttcaattctttgccttctacttttaaacttcacttcctcataaagcaaccttttgcgatcatctgctccaccctgactcattccaatcacctgctccaccctgactcattctgatcacctgctctgcccagactcattcccatcacctgctccaccctgacttattccaattacctgctccaccctgtctcattctccaccctgactcattccataaccatttttcccaccaaaccagtcaccccctcaccctctttaaattagctaatcggaattagtttagcttgtgtggtctaacctagccaatagatgaatgacacagcagcaggagccacgttcgtcagggataagaacaccttccccttccttgtccaggggtgtactcaccattgctccatctgtgagggcgcacccttctatagaagtaaattgccttgctgagaagaaaaaaagaaaattttatatttgagtgctatttattttgtggcaccaaaactatttataacatacctgatctttattttaaatttttgtttatttaaatattaaatatattatccacctggtattaatttgtttaaataaatgtgaggtagggttccattgctattttttaaccaggtaggttatattgactaaccttcactttgaaagtgatttgaaatacacttttcatttattaaattctcccttgtgtttaggcagtaaggcataatatttgagagtgtgggctctgcagtccagctatctgggtttgaagtttatctcctttatttgcgagtggtacaaacttgaacaaattatgtaatttgtttttctcaattccctcatgcactaagtgaggataaaaatagcaataacaccatgagattgctgataacaaaatgcaaggtaaaaattgtgtaaggcttaaaattgtgtagcctggtatacaagaggctctaaataacataagctattattgcttttctacttattattatttctggcttttgtagtctttttcccattgttgatctttctactattcacaaagcatgagtctagtatctgtagatttataaactaattaatgtaacttttcaatatgttttaatatctcatagatactgttcttcctcattacttttctattttataaatttctatttcatctgcttcataaattttgcattctcataaactaagaatcatctcctgtagttaaaaaatattgtttgtatttttgttgggagtagagtgaattaaaatatattgacttaaggagaactgacatctttataatattgaatcttcctgtttgagattggactttatgtccatattttaaagtctttgtttatgaccctaagtataattttaacgtttttatattaggcttatttctagatactttttgttaatatatcatctaactggttgttcttcatatatataatgactatgaattttttctcagtcttttttctgaattctcacatcatttgtgttatatttttaagttgattctcttgagtttttcaggtaaacaattatatcacctataaaaataatgttgccaccttaaattaagaaaatgtttttctattgtctaattgcatggactgttgcctcaggaacagtataagattgcttacaaaagccttgctttcttgttccagattttaaaaacaaggctttcaatgacaatctcgctagcaagaagctggtatacttacatacatacatacaaacagacagacacccactttctatatgtatatctagatagatttagatagacatatatgtgtgattcctgttaagatgaatctatttttggtatttaagattttaaaaatctagaatgggtattattatattgtattgaagctcttaagcatctatggaaatgaaagtatgattcttctctttcgactaattaatatgtgatccatagtattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggtttt

SEQ ID NO: 6715 - DNA, 3427 bp, Homo sapiens
gtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggaacttgaaagcataagcgaagatgttcaagcaatgagcaactgttgtcaagatatgacaagtcgcctacaggcagcaaaggaacagactcaagatttaatagtaaaaaccactaagcttcaatctgaaagccaaaaattagagataagagctcaagttgcagatgccttcttatccaagttccaactgacttctgatgaaatgagtcttctccgaggtacaagagaaggacccattactgaggattttttcaaggcactgggaagagtaaaacagattcataatgatgtcaaagttctcttgcgtacaaatcaacaaacggcaggtttagaaattatggaacagatggccttacttcaagaaacggcttatgaaagactttaccgatgggctcaaagtgaatgcagaacattgacacaagaatcatgtgacgtatctccagtattgacacaggcaatggaagccctgcaggacagacctgtcttatataaatataccttagatgaatttggaacagccagaagaagtacagttgttcgtggatttattgatgcgctcacaagagggggccccggaggtacacctagaccaattgaaatgcattctcatgaccctttgaggtatgtaggagatatgttggcttggctccatcaagctactgcttctgaaaaggaacaccttgaagctctcttaaagcatgtaactacacaaggtgttgaagaaaatattcaagaagttgttgggcatatcactgaaggtgtgtgcaggcctctaaaggttcgaattgagcaagtaatagttgctgaacctggggcagttttattatataaaatttctaatctcctcaaattttatcaccatacaatcagtggtattgttggaaatagtgcaactgcattattgactaccattgaagaaatgcatttgctaagcaaaaaaatattcttcaatagcttgagtcttcatgcaagtaaattaatggacaaggttgaactcccaccacctgatcttggaccaagttctgcactaaatcagacactcatgttgctgcgtgaagttttagcatctcacgattcttcagttgtaccattagatgctcgtcaagctgattttgtgcaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcagatcgaagcacatttggacacacttataaatgagcaagcctcttatgttttaactagggtaggcttgagttacatctataacactgtacagcaacataaacctgaacagggctctttagctaatatgcccaacctagattctgtgacactgaaggctgcaatggttcagtttgatcgttatctgtcagccccagacaacctattgataccacagctgaactttcttctaagtgccacagtgaaagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaaga

SEQ ID NO: 6716 - DNA, 2926 bp, Homo sapiens
tcccagccgcaaactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggaggaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtgttggtagaaattgaccaagtgaagtccagaatgcaacttgctgccgaatctcttcaggaagcagataagtggagcacgttgagcgccgatattgaggagacatttaagactcaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtagatcagtccaaagtgtttgtgaaggtgtttactgaaattgaccggatgccccagctcctggcctactactacaagtgtcacaaggtgcagcttttagcagcctggcaagagctgtgtcaaagtgacctatccctggaccggcagcttaccggactctatgatgccttgcttggtgcttggcacacacaaatccagtgggctacacaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacatgaacacaatctggtaaaagtcacggagctggtggatgctgtgtatgatccatacaaaccctaccagctgaagtatggcgacatggaagagagcaacctcctcatccagatgagtgctgtgcctctggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtatgtgtctgatttcaccagcactctccagtccatacgaaagaagtgcaaactggaccacattcctcccaactccctcttccaggaagattggacggcttttcagaactccattaggataatagccacctgtggagagcttttgcggcattgtggggacttcgagcagcagctagccaacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacagctggaatacggctggcatcggagaaaccctcacagatgaactgcccgcctttagtctcacccctctcgagtacatcagcaacatcgggcagtacatcatgtccctccccctgaatcttgagccatttgtgactcaggaggactctgccttagagttggcattgcacgctggaaagctgccatttcctcctgagcagggggatgaattgcccgagctggacaacatggctgacaactggctgggctcgatcgccagagccacaatgcagacctactgtgatgcgatcctacagatccctgagctgagcccacactctgccaagcagctggccactgacatcgactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctcaaaaaaaaaaaaaaaaaagacttggttcatttgtataatcaaaaagagttgtaaattaaagatgtattatttatcagagaagactttttagataatttttttaaaggatcagatcttgaaaatggaataaataactactgtgaaatgcaa

SEQ ID NO: 6717 - DNA, 4190 bp, Homo sapiens
aagttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggccatttgtgccgagttcttatttttacggagggcttgtggccttagacgccagtttgcttatggaaatgaaagagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtggatcacgaggtcaggagctcaagaccagcctggccaagatggtgaaaccctgtctctactaaagatacaaaaattagccgggcgtggtggcgagcacctgtaatcccagctactcgtgaagccaaggcagagaattacttgaacccaggaggcggaggttacagtgagctgagatcacgccactgcactccatccagcctgggcgacagagcgagactcaaaagtatgattctggctgtagagttttctttttttctctgtctcaaaaaaaaaaagtgtcagctttgtcttgtcaagaggtgaaggaacttgttttattcttttattttttttttaagatagagacgggggtcttactatgttgcccaggctggcctcaaattcctggtctcaggcaatcctcctgcctcggcctcccaaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgca

SEQ ID NO: 6718 - DNA, 4814 bp, Homo sapiens
ccaccttggccgggattaccctccgagttccaggccatgacaaatgacatcactcccggcccaggcttaaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagctctgtcgcccaggctggagtgcagtggcacgatctcagctcactgcaagctctacctcccgggttcacgccattctcctgcctcagcctcccgagtagctgggactacagatgcccaccaccaggcccggctaattttttttgtatttttagtagagacggggtttcaccgtgttagccaggatggtctcgatctcctgacctcgtgatccgcccgcctcggcctcccaaagtgctaggattacaggcgtgagccaccgcgcccggcccttttttttttttttttttttaattgagacggagtctcactcttttgcttaggctggagtgcagtggtgtgatctcagctcactgactgcaacctccacctcccgggttgaagcgttgctcctgcctcaatctcccaattagctgggattacaggtgtgctccatcatgcccggctaatttttctattattagtagagacagggttttaccatgttggccaggctggtctggaacccctgacctcaagtgatccgcctgcctcggcctcccaaagtgctgggattacaggcatgagccattgtgcctggccctacacgtggacacttctttagcatatggttagggacctttctagaaattccaaagacagactttaagaagccccgtcgggaaaccttaggccaatgatgtggttacattaaaaataaattatctgggaatttcacagacttcacaaatgtcaggcttacatggtaggtttaggggaccgtttgagagacaaagatctacattcatatatgtagctatacatatatgtactttttcttcttagtttctttttaaagacattttatcactcattcgctcattagcacattgggaatgtgtgtatttggtagggaaatgaaaggcaccttgcctgttccatctctactccttttttcttttgttttaggattttctaaaggtgagacactggtggaactggggtagctgcttgggacgtaccacctatagttgtggctatttcacagagaagcagcagctagacagactcccatctgtaaataaacaagagataggaagagggggaaatagatttggaggaggcagccctacatttcaaacatacattcccttttttagatttttttttttttttttttggttttcagttttgatggtgggattggaaaatagagcttggcttgaggacattttcctggggtggcaccattatttcttgaaatagaatcttacttatggtgacactggcaagcacttgtgagaacctgaagacggattgaggtcatttgatgctcagaagttgggtgctgggtccctgccttctcagtccgagttctcctttcatttttgggtggggaggcgggttccaagagcccttcattggtggagttcacaaggcaaggtgtaaaaaaaaaagtagggcaggaagacagtggtgtgctggcagaggtctaacaatgggctctccaaggaagaggaaaaggttggttgtggagtgtttgtcagtttccgtggtgtaaatactcccaccacggctgacttcaagctagcaaccggaggtcactgaactaagagttgggaagagatagggcacaatatatgcttacgagttggtacacaccgtcagcagcagccagggtcaggagaaaggcgagatgtgaagagaggccgggaggtatcagatgacgtttccagcactagaccagaagaggtgcacacagcctagaccccctgaggggtacaccctgatctctagagcccacaaagaggtttttattcaacataaaacgtgttcatctctcataggcctgagtcatgctgggttctgggacattaagcccaggagtgggccgggtgcggtggctcacgcctgtaatcccagcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaagtctgggtgattctttagtttccgtgttttctccaggaggggcaggtagaaacaggaactactctgttccttctgtctgtggggcctgggtccctccatgtgtttcctgtctcatcaccctcctttccttgacatctctctaaagccaatttatgaaggatcaggggctgggtgcagtggctcacgcatgtaatccagtgctctgagaagctgaggagggaagattgattaaggccaggagtttgagaccagcccaggcaacatagcgagatctctgtctctacaaaaaattaaaaaaatcaaccgggtgtggtgatgtgtgcctgtggtcccagctactcggga

SEQ ID NO: 6719 - DNA, 981 bp, Homo sapiens
atgatggcgtatatgaacccggggccccactattctgtcaacgccttggccctaagtggccccagtgtggatctgatgcaccaggctgtgccctacccaagccctcccctggccctggaccctccaaggagacagcggcaggagcgcacggtctacactgaaagccagcagaaagtgctagaattttactttcagaaggaccagtacccgaactacgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgtagccgctgcctccttccctgggggtcctgagttcccgcagggcaggggttcctggatctcccctcagccgggcccctggggagtcctcccagcagcagaaccgaagatctacagcctcccccggacctggggtggccctgagtgtggaacacaggagggcctcaaggctgtcccggctccaggccctggcccaatcccagcccctatcccaggcccagcccagatcccaggcccagtcccaggcccagccccgaatttaggcccaatgtcaggcccactgtcagtctcgatccccggtccaataccagcccccatctcttgcccaggcccaatcccagacccagtcctaggccgaaccctgatgccaggcccaggatcactcccaaccccagccccaggcgccttgtggcctcagagcccctatgcctccaacttgtcgccagacacccagttataccctgacttcaccaagctgctcccgctcctagaccggttcgaggaatcctcactctccaccacgacgtctcagtacaaagaggaggatggcttcgtggacaaaaatcactcagtccccaggtcattactggatttatag

SEQ ID NO: 6720 - DNA, 2275 bp, Homo sapiens
taaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacagtctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctc

SEQ ID NO: 6721 - DNA, 2276 bp, Homo sapiens
taaaatctccccatgtgaggggatgtgtttccttcagcctctgctgtctggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctca

SEQ ID NO: 6722 - DNA, 2241 bp, Homo sapiens
ggccgctctgtctaggtcctgggccacgggagagccccgtccctcctttctgaaggccccctgacttgggcctcagtgtccccgaagatcatgatggcgtatatgaacccggggccccactattctgtcaacgccttggccctaagtggccccagtgtggatctgatgcaccaggctgtgccctacccaagcgcccccaggaagcagcggcgggagcgcaccaccttcacccggagccaactggaggagctggaggcactgtttgccaagacccagtacccagacgtctatgcccgtgaggaggtggctctgaagatcaatctgcctgagtccagggttcaggtttggttcaagaaccggagggctaaatgcaggcagcagcgacagcagcagaaacagcagcagcagcccccagggggccaggccaaggcccggcctgccaagaggaaggcgggcacgtccccaagaccctccacagatgtgtgtccagaccctctgggcatctcagattcctacagtccccctctgcccggcccctcaggctccccaaccacggcagtggccactgtgtccatctggagcccagcctcagagtcccctttgcctgaggcgcagcgggctgggctggtggcctcagggccgtctctgacctccgccccctatgccatgacctacgccccggcctccgctttctgctcttccccctccgcctatgggtctccgagctcctatttcagcggcctagacccctacctttctcccatggtgccccagctagggggcccggctcttagccccctctctggcccctccgtgggaccttccctggcccagtcccccacctccctatcaggccagagctatggcgcctacagccccgtggatagcttggaattcaaggaccccacgggcacctggaaattcacctacaatcccatggaccctctggactacaaggatcagagtgcctggaagtttcagatcttgtagaggacgcagtctccatctctctccatcgggcctcgggaccctttctcttctgaatctgcttccctgcagtttagatcccgggatggcattcctgagaaagcaacccgaaccagctgtccttctgacagctcggtgttcagcttacagagaccacccctttcctccacagggagaggctcctccctctcctgggacagctcacaggtcctagtgattctctcaaccctaacaccgtctggcacgattgtgaccgctgaagtacaccacgagctccaggcttcagaaagtggtgctgagaacttgctccaagaagaagtcaaaccaaacttgcagttgatttggggtcatgtttaggtcagaatcaccgtgcccttgaacaagcaggtaggggggcttgataacttaactttccacgtggacagaatttttttttttgttttgtttttgttttgcagacacaattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctca

SEQ ID NO: 6723 - DNA, 4722 bp, Homo sapiens
ccgggtccctccccatcccgcgacccaacggtcgttccccgccgccggccccgcccctccctggccgcccgcggcgcgccggcgcctgcgcagtcgccccagagcgccccgaccgggatggcggccgttttggagtcgctgctgcgagaagaggtgtcggtcgcagccgtcgtgcggtggatcgcgcgcagcacccagggttcggaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacagagactcagctctcatgcaggagatgggtaccacgaaggctctggggagtcagtcattcgagctcggcgctccgcagtggagcgccaggatgcaggacgaagccttctcgcaggatcaacccaactccggtgagcgaagagcggtcactctccaagcccaagacctgcttcacctcacccccaatcagctgtgtccccagctctaagcagctgcagcagtcacctacccccacctgtcccaccccagaattggggtcgcccctccccagccggacaggaagcctcacagatgaacctgcagaccctgccagagtgtcttcccgccagcgcctggagcttgtagcccttgtttactcctcgtgcattgctgagaacctggtaccaaacctcttcttggagcttttcttcgtctttcagctcctcactgcccggaggatggtgactgccaaggacagcgaccctgaactaagtccagctgtcctagattccctggaaagtccactgttccaaagcatccacgattgtgtcttctttgcagtgcaggttttggagtgtcactttcaggttctttccaacctggacaaagggaccttgaagctgctggctgagaatgagcggctgctgtgcttctcaccagctctgcaaggccgccttcgagctgcctatgagggcagtgttgccaaggtctctctggtgatgcctccctctactcaagctgtctcctttcagccagagactgacaatcgtgccaacttctccagtgaccgagcctttcatacttttaagaaacagagggatgtgttttatgaggtgctgcgagagtgggaagatcaccatgaggagcctggctgggattttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttcttt

SEQ ID NO: 6724 - DNA, 4728 bp, Homo sapiens
ccgggtccctccccatcccgcgacccaacggtcgttccccgccgccggccccgcccctccctggccgcccgcggcgcgccggcgcctgcgcagtcgccccagagcgccccgaccgggatggcggccgttttggagtcgctgctgcgagaagaggtgtcggtcgcagccgtcgtgcggtggatcgcgcgcagcacccagggttcggaggataacgctggggaggcggccgcgctgagctcactccgggccctgcggaaagaattcgtaccgttcctgttgaacttcctgagggagcagagcagccgcgtcctcccgcaggggcccccgacccccgccaagaccccgggcgcctcggcagccttgccagggaggccgggaggcccgccgcggggtagccgcggggcgcgcagccagcttttccctccgaccgaggcccagagcaccgctgccgaggcccctctggcccgccgcgggggcaggaggcggggcccggggccggcccgcgagcgtggaggccgcggcctggaggagggggtcagcggggagagcctgcccggagccgggggccggaggcttaggggctctggcagccccagccgccccagcctcacgctgtctgatccgccaaacctcagcaacctggaggagttccctcccgtaggctcggttccccccggccctacagggacgaagccttctcgcaggatcaacccaactccggtgagcgaagagcggtcactctccaagcccaagacctgcttcacctcacccccaatcagctgtgtccccagttcccaaccctcagccctggacactagcccttggggccttggccttcccccagggtgcagaagtctgcaagaggagcgagagatgctcaggaaggagcgctctaagcagctgcagcagtcacctacccccacctgtcccaccccagaattggggtcgcccctccccagccggacaggaagcctcacagatgaacctgcagaccctgccagagtgtcttcccgccagcgcctggagcttgtagcccttgtttactcctcgtgcattgctgagaacctggtaccaaacctcttcttggagcttttcttcgtctttcagctcctcactgcccggaggatggtgactgccaaggacagcgaccctgaactaagtccagctgtcctagattccctggaaagtccactgttccaaagcatccacgattgtgtcttctttgcagtgcaggttttggagtgtcactttcaggttctttccaacctggacaaagggaccttgaagctgctggctgagaatgagcggctgctgtgcttctcaccagctctgcaaggccgccttcgagctgcctatgagggcagtgttgccaaggtctctctggtgatgcctccctctactcaagctgtctcctttcagccagagactgacaatcgtgccaacttctccagtgaccgagcctttcatacttttaagaaacagagggatgtgttttatgaggtgctgcgagagtgggaagatcaccatgaggagcctggctgggattttgagaagggcttgggcagcagaatcagggccatgatgggtcagctctccgcagcctgcagccacagccactttgttcggcttttccaaaaacaactactccagatgtgtcagagccctggtggtgctgggggcaccgtcttgggcgaggccccagatgtgttgagtatgctgggagctgacaagctggggcggttgtggcgcctacaggaacggcttatggctcctcagagcagtggggggccctgcccaccccccaccttcccaggctgtcaaggcttctttagggacttcatccttagtgccagcagcttccagtttaaccagcatctcatggacagtctgagcttgaagatccaggagctcaatggtcttgccctgccccagcatgagcccaatgatgaagacggggagtcagacgtagactggcagggtgagcggaagcaatttgctgtggtgcttcttagcctgagacttttggctaaattcctgggctttgtggctttcctgccataccgggggcctgaacctcccccgaccggtgagcttcaggactccattctggccctcaggagccaggtccctccggtcctggatgtgcggactctgctgcagcgagggctgcaggcccgccgggcggtgctcaccgtgccctggctggtggagtttctctcctttgctgaccatgttgttcccttgctggaatattaccgggacatcttcactctcctgctgcgcctgcaccggagcttggtgttgtcgcaggagagtgaggggaagatgtgtttcctgaacaagctgctgctacttgctgtcctgggctggcttttccagattcccacagtccctgaggacttgttctttctggaagagggtccctcatatgcctttgaggtggacacagtagccccagagcatggcttggacaatgcgcctgtggtggaccagcagctgctctacacctgctgcccctacatcggagagctccggaaactgctcgcttcgtgggtgtcaggcagtagtggacggagtgggggcttcatgaggaaaatcacccccaccactaccaccagcctgggagcccagccttcccagaccagccaggggctgcaggcacagctcgcccaggcctttttccacaaccagccgccctccttgcgccggaccgtagagttcgtggcagaaagaattggatcaaactgtgtcaaacatatcaaggctacactggtggcagatctggtgcgccaggcagagtcacttctccaagagcagctggtgacacagggagaggaagggggagacccagcccagctgttggagatcttgtgttcccagctgtgccctcacggggcccaggcattggccctggggcgggagttctgtcaaaggaagagccctggggctgtgcgggcgctgcttccagaggagaccccggcagccgttctgagcagtgcagagaacattgctgtggggcttgcaacagagaaagcctgtgcttggctgtcagccaacatcacagcactgatcaggagggaggtgaaagcagcagtgagtcgcacacttcgagcccagggtcctgaacctgctgcccggggggagcggaggggctgctcccgcgcctgtgagcaccatgctcccctcccctcccacctcatctccgagataaaagacgtgctctccttggccgtggggccacgggaccctgacgagggagtctccccagagcatctggaacagctcctaggccagctgggccagacgctgcggtgccgccagttcctgtgcccacctgctgagcagcatctggcaaagtgctctgtggagttagcttccctcctcgttgcagatcaaattcctatcctagggcccccggcacagtacaggctggagagagggcaggctcgaaggcttctgcacatgctgctttccttgtggaaggaagactttcaggggccggttccgctgcagctgctgctgagcccaagaaatgtggggcttctggcagacacaaggccaagggagtgggacttgctgctattcttgctacgggagctggtggagaagggtctgatgggacggatggagatagaggcctgcctgggcagcctccaccaggcccagtggccaggggactttgctgaagaattagcaacactgtctaatctgtttctagccgagccccacctgccagaaccccagctaagagcctgtgagttggtgcagccaaaccggggcactgtgctggcccagagctagggctgagaagtggccctgccttgggcattgcaccagaaccctggacccccgcctcacgaggaggcccaagtgcccaatgcagaccctcactggttggggtgtagctgggtctacagtcagacttcctgctctaagggtgtcactgcctggcatcccaccacgcgaatcctagaggaaggagagttggcctgatttgggattatggcagaaaagtccagagatgccagtcctggagtagaagaggtggtgtttgtttatctcttggatactaaatgaaatgaggtgtgtgggcttgtcaacacagaattcaagcctcatttgctatcccagcatctcttaaaactttgtagtcttggaattcatgacagaggcaaatgactcctgcttaacttatgaagaaagttaaaacatgaatcttgggagtctacattttcttatcaccaggagctggactgccatctccttataaatgcctaacacaggccgggtctggtggctcatgcctgtaatcccagcactttgagaggcctgaggtcggcggactgcctgaggtcaggaattcaagaccagcctggccaacatggcaaaaccccatctctactaaaaataaaaaaattattagctgggcatggtggtgtgtgcctgtaatcccagctactcaggaggatgaggcaggagacctgcttgaacctggaggtggaggttgcagtgagccgaggtcgcaccactgcactccagtctgggtaacagagcgagactttctagaaaaagcctaacaaacagataaggtaggactcaaccaactgaaacctgactttccccctgtaccttcagcccctgtgcaggtagtaacctcttgagacctctccctgaccagggaccaagcacagggcatttagagctttttagaataaactggttttcttt

SEQ ID NO: 6725 - DNA, 4478 bp, Homo sapiens
gtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 6726 - DNA, 5315 bp, Homo sapiens
gagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctta

SEQ ID NO: 6727 - DNA, 5668 bp, Homo sapiens
gtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatgaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagtgaaagcagagaagaaaagttaggagactcattgcaagatttatacagggcactggagcaggccagtctgtcaccactaggagaacatcgtatttcaaccaagatggaatacaagctatcatttataaaaagatgtaatgatcctgtaatgaatgaaaaactacaccggctgagaattctcaaaagcactttaaaggccagagaaggggaagtagccattatcgataaagtcctagacaatccagacttgacatctaaagaattccaacaatggaagcagatgtacctcgaccttttcttggatatctgtcaaaataccacctcaaatgacccactgagtatttcttctgaagtagatgtaatcacttcctctctagcacacactcattcatacattgaaacgcatgtctaaatgtattctgccttcagaccatctagtacctgctggtactctgaacaagtatataaggtagtttttatatcaatgtgtggaacacttgacaagctatactttaatgttaccaaactatatgaaacaaaccatatatggtcacaataccactatctttaatgagcatttgtatattttatatgcaacagtgctcagcttatgtttaccatgtgcaaaatcaactgtctttaatgacttaaaattaacttttgcaaacaattctaaatacaggtggtcttcaagtagtaaaaccacaaaaggcagttttctatctatggtcatcttttctccctttaagttaattttatataaacaagacttcaaaagtaaatcacattttttcaggtgcagacatccttgtgggtgggaaagaatttaaaccttttttatatttattaaaatgttctaagaattttcttaaacattgcacaaagtttaatgctgtagttttatttttgtgaaatgtagatgcgcatacaagagctaagcaaaatagaagagcatcgacataagaaaagttcaggtatctaatattcgtcttaatagtctattaacttgtgaaagctaagttaatggaaatattattccaaatctatgagaacacttggtgtatcagggcaaagctttgtaagatgtttttgtaactaagaccaaaattgaagatagagctgctttattttcttggtttaaatcttcctttatttttgtagtgatgagatgctgattgtgtacagaagaatttgagaggggatttttaaaaactgacttaacacacccagaaaggcagctaacagctatatatatatataaatttcagcccaaactcatgtttttaaactccaactcttaaaagacaacaaggtataaactgaaatgaatcaactttccacttagtttccaattttcccctagtccactaattaaacttaggtaattatacttcaggtagggaagtacaatatgtttagtttcaggctgatgtgtgttataaaaaacaacactgaaaaataaaaatgtacttcccttctaaggagcaagcaggtgatggtcattcaaagagatgtcacattgaattatgagagaaacaatttagaggtttttttcctggcttcatgaattgttctatagagtggatgaagtctaaggaaaagtcctcttcatatatttccatttataagcgtcttgtttttgaaagtgatcacagcatgaaaatgactgtgctgctttttagtgtctggctgcataatgtacaagtcacaatttgctgtttttttcaggaggagaaagggaacctcctttactattctatatcctaaaatctacttctaatcagctttatactgttgcctgtacagctcagtgaatgtactttcatctttaagagttcagatatatgccagtgaatatttttgctgtagaggagaaagtaaaaactccacagcggggatctttttctttgcttttgaaaccaccattgaatcactatcgttttgcagactttgcacaactgtacaggagagtggcctttctacagcacattttcagtaatcctatatttagtcaaaatggatgagaaatcatgtattaatgtttgtatggaattttgggtccagtgtaatatttttatcatttaaaaagaactctatttgtaaaaacatttatttactgcatggatattgacgcacattaaatttgtgggattttgtatatgtaaaaaaaaaaaaaaaaaaaaaacaaaaaacctcttgtcctaaaatgaagtgtgcttgttaacaggtgtttagacttattgatgtttactagaccaaatgtgtatgttcacttaaaaatatatgtacctgatggatgtgtcatgtttacagtggccaggttgtggcctgtaaacagcaagcagttgacgggaagactagctctgttgctactaagcagcttttacttttgtaaagtcagctctgttgttttaaatggtaaaaattaaactaatgaatttgacaagactcgtggctagcctagcatgaaagagaccttttaacactatataatatctgtacattttattgcattcgtttcaaatctaggagagaggcagcactgtaaactgaagtcaaataaattcagctcttaatgaatcctt

SEQ ID NO: 6728 - DNA, 4355 bp, Homo sapiens
gtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtcttgatgactgtttgcagcagtatattaagaactttgagagggagaagatcagtggggaccagctgctgcgcattacacatcaggagctagaagatctgggggtcagccgcattggccatcaggaactgatcttggaagcagttgaccttctgtgtgcattgaattatggcttggaaacagaaaatctaaaaaccctttctcacaagttgaatgcatctgccaaaaatctgcagaattttataacaggaaggagaaggagtggccattatgatgggaggaccagccgaaaattgccaaacgactttctgacctcagttgtggatctgattggagcagccaagagtctgcttgcctggttggacaggtcaccatttgctgctgtgacagactattcagttacaagaaataatgtcatacaactctgcctggagttaacaacaattgtgcaacaggattgtactgtatatgaaacagagaataaaattcttcacgtgtgtaaaactctttctggagtctgtgaccacatcatatccctgtcgtcagatcctctggtttcacagtctgctcacctggaagtgattcaactggcaaacattaaaccaagcgaagggctgggtatgtatattaaatctacatatgatggcctccatgtaattactggaaccacagaaaattcacctgcagatcggtgcaagaaaatccatgctggcgatgaagtgattcaagttaatcatcagactgtgcctcttatacctagaagtcccacaagcagcgttgccacgccttccagcaccatcagtacacccaccaaaagagacagttctgccctccaggatctctacattccccctcctcctgcagaaccatatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatggcaagctacgacctatatctatgccagtggaatataattgggtgggggactatgaagatccaaataagatgaagagagatagtagaagagaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgtgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcagtgtgtggtattgcataatgtgaatacctgtaaaaatataaattacttaaaaataaaaatatgaccaattggtatcagatcttttcagatagctaaataatttgctaagtatgcctgatagtaaatatctttctaaaaagaagtaatcagtgcttctttctcacaaatggaatttgtgtctgtgaataaaatcacattgatctgcc

SEQ ID NO: 6729 - DNA, 645 bp, Homo sapiens
ggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccagatagcagaatcctatttccaggaggaggactatgagaaagcaatgaaattcattcagctagaacg

SEQ ID NO: 6730 - DNA, 2422 bp, Homo sapiens
cgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccggacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcagatagcagaatcctatttccaggaggaggactatgagaaagcaatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggtaaatcagagatgaagtacaattaaaagtaaaatggcatttaaaaaacatatatatgtattaaatattgccttgtttttgtaagttttcccttgtctcaaacatgagggaaaattctagttaacgtaagcttttaattattagtagtttttacatttgtatgtattgaataaaatgacttttaatcattgcaatgttcatactac

SEQ ID NO: 6731 - DNA, 5126 bp, Homo sapiens
tctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcagatagcagaatcctatttccaggaggaggactatgagaaagcaatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcattaaaaaaaaaacaacaaagaaaaaccaaacatgaattatagtttttaacaagtgatctttatttcctgtcttctgttaggatcatttgaaagaaaaagggagaacttactttctagttgttactggctggcacagtacctccctttgtgtttctgcttatttatttagattatgtgaatcttaaagggctttttatatcagttgaaagtgtgttactgcgcatgcatttggtgattccagtgctagatatttaattactgtgtatttagtgttttgattttctataatttcagttccgcgtgtttttacacttgttcattttaaattgatgtttcattttcacttataatactgtttgacttgtctctatcatgtcaccataaactgtaatattttcaagggttatagatcaaagatatttatttagaaatgtacaagataatgaaatttagattccttatacttaaggctgattttattagaagattattttaatgttctattataaattttaagaatttgtattcaaattgtatgtaaaatatgtaaaatgttgacggtactatattaagtggttctataaaagctattcacaagttctactgtgatggacatcctcatcatagacaaacctcctctgttttatcctcaatttctagttacagaaatttggtgatgcttatttttgccaattttatgtcaaaataagttaaaacttccctcctgttcacctcttgggtctctatcctgtgtaacctctggtgtagtatttgcccataggcaaccagagccacttcctctgaacccaacatctcctggggaccttcgcagcaagaggaaagcactgagacaatagcttgctaagcaggggcccagtggtgtctcagagaaaccatgggtgtcctcgccacttcccagggagggtgaggtgagctcgggaacataacgatgttttgacttacaataggcatgaaatcgcaactagaaaaattagggcagtttttaaaaatgtcatagttatctattgcatgaactggagtaattccacctggtggtgaaaggattgttatttcacacatgaaaaattcatccagttttactaaaatgtaattttttctgtcatttgaaagtactgacaactatttgtaactaatcttccttaagaactgtatttgagggtatcaaatcaagcttgtaatttaaaatctgtaccaacaaagtgtctcagagagtttatttgaaccattgggtgctgagaaaaaactgctttaaagtgaaactttgatttcagaagttgatctggccctacaagtagacagtcatctactttgggaagactaataggtccttaggtaacggctcttctgctttaaaatacctcccccatctgctgacagtagctgaagattattctaaacattcattcttttagatttaaaaataaaaatcttctggaggatt

SEQ ID NO: 6732 - DNA, 3393 bp, Homo sapiens
caggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgat

SEQ ID NO: 6733 - DNA, 3328 bp, Homo sapiens
gtttaaaattatccaactgccatagagctaaattcttttttggaaaattgaaccgaacttctactgaatacaagatgaaaatgtggttgctggtcagtcatcttgtgataatatctattactacctgtttagcagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaa

SEQ ID NO: 6734 - DNA, 1963 bp, Homo sapiens
caggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtga

SEQ ID NO: 6735 - DNA, 3033 bp, Homo sapiens
cttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagaca

SEQ ID NO: 6736 - DNA, 3125 bp, Homo sapiens
gctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagaca

SEQ ID NO: 6737 - DNA, 553 bp, Homo sapiens
agctgaactgaatttacacgaaaagggaaggaggaaaatggtttgtctttttttgcagagaattctatccaaattcacttgcatttaattacttcatattttggaaatgacattttcaaccatgtgacaaatctgcagcccctttgccatgattaaaggtctcctgaggccctgaccagaagcaaacgctagtgccaggcttcttgtacagcccgcaaaactgtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgat

SEQ ID NO: 6738 - DNA, 5109 bp, Homo sapiens
tccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccattatcaaatcatgagttgaaagattttgactattgaaaaccaaattctagaacttactatcagtattcttattttcaaaggaaataattttctaaatatttgattttcagaatcagttttttaatagtaaagttaacataccatatagatttttttttacttttatattctactctgaagttattttatgcttttcttatcaatttcaaatctcaaaaatcacagctcttatctagagtatcataatattgctatatttgttcatatgtggagtgacaaattttgaaaagtagagtgcttccttttttattgagatgtgacagtctttacatggttaggaataagtgacagttaagtgaatatcacaattactagtatgttggtttttctgcttcattcctaagtattacgtttctttattgcagatgtcagatcaaaaagtcacctgtaggttgaaaaagctaccgtattccattttgtaaaaataacaataataataataataataattagttttaagctcatttcccacttcaatgcaatactgaaaactggctaaaaataccaaatcaatatactgctaatggtactttgaagagtatgcaaaactggaaggccaggaggaggcaaataatatgtctttccgatggtgtctcccaagtgttggtgctttgggtttttataagttgtgaaaaggaagatgcacatttcttcattctccatggtgtgcatggaaatgtgtttgagtgtggatgtaaaagaaatcgagtaataaagaattagctggcttgtgaaatagtgcagtgttggatgcttcaagaggtataatcctattttattagcacaaacttgctagctaattagagtttatctttttagaaaggacaccgtataggttcgtaaaaaatatttacaggaagcaaaatagatctattactactttaccgactttaccccctttctttaatttgtataatttttgtactatatatcgatgtgtaaatgtttagagtcttcattatgaaaatatcaataaatatttcattagtttacatttaactctggtataaaatgaaacttttaaaaataagtgaaatggatgatttcccagtggaagtatgtcaacagtcttaagatcattgccagatttcataaaatatttaagtatttgaaaaagaaacaaaatgtcttcatactttagggaaacgaataccctgtataccttctgtacaaatgtttgtgttttcattgttacactttggggttttacttttgcaatgtgacccatgttgggcatttttatataatcaacaactaaatcttttgccaaatgcatgcttgccttttattttctaatatatgataataacgagcaa

SEQ ID NO: 6739 - DNA, 555 bp, Homo sapiens
gggtgggctccgccgaggcgaggaggggcgccggtggggagatgcgctcccaggtgtttgcagcggaagtgggaaacctgtagggtatggtccagctgtgccgcaccgaggcgagcaggagcagggaacagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcact

SEQ ID NO: 6740 - DNA, 463 bp, Homo sapiens
ctgaactgaatttacacgaaaagggaaggaggaaaatggtttgtctttttttgcagagaattctatccaaattcacttgcatttaattacttcatattttggaaatgacattttcaagtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcga

SEQ ID NO: 6741 - DNA, 572 bp, Homo sapiens
aacttgctttctgctgcaggagagaggcgtattgtggtataactgttgctgtatttattcaaatggacaatttgcaatagatattatacccaggacgacagataagtcaacacataagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttccc

SEQ ID NO: 6742 - DNA, 8141 bp, Homo sapiens
gctccgggcgcgctcacacacacgcgccctcacccgccaccgccgccgcggccgccgccgcacccggacagcgagcggctgaggccgccagggcccaaaggacagcggcccagacaggggctggcggcccggccggccccggctcaccgactcgggcagcatccacctgccccagccaacacccttctctcgccccaggtcctttctcagcctccagctgggctgtccccaagctgagctgaggctcttctcctccgatccccacctctgcccggacatccaccatggggacagccaccaggaggaagccacacctgctgctggtagctgctgtggcccttgtctcctcttcagcttggagttcagccctgggatcccaaaccaccttcgggcctgtctttgaagaccagcccctcagtgtgctattcccagaggagtccacggaggagcaggtgttgctggcatgccgcgcccgggccagccctccagccacctatcggtggaagatgaatggtaccgagatgaagctggagccaggttcccgtcaccagctggtggggggcaacctggtcatcatgaaccccaccaaggcacaggatgccggggtctaccagtgcctggcctccaacccagtgggcaccgttgtcagcagggaggccatcctccgcttcggctttctgcaggaattctccaaggaggagcgagacccagtgaaagctcatgaaggctggggggtgatgttgccctgtaacccacctgcccactacccaggcttgtcctaccgctggctcctcaacgagttccccaacttcatcccgacggacgggcgtcacttcgtgtcccagaccacagggaacctgtacattgcccgaaccaatgcctcagacctgggcaactactcctgtttggccaccagccacatggacttctccaccaagagcgtcttcagcaagtttgctcagctcaacctggctgctgaagatacccggctctttgcacccagcatcaaggcccggttcccagcagagacctatgcactggtggggcagcaggtcaccctggagtgcttcgcctttgggaaccctgtcccccggatcaagtggcgcaaagtggacggctccctgtccccgcagtggaccacagctgagcccaccctgcagatccccagcgtcagctttgaggatgagggcacctacgagtgtgaggcggagaactccaagggccgagacaccgtgcagggccgcatcatcgtgcaggctcagcctgagtggctaaaagtgatctcggacacagaggctgacattggctccaacctgcgttggggctgtgcagccgccggcaagccccggcctacagtgcgctggctgcggaacggggagcctctggcctcccagaaccgggtggaggtgttggctggggacctgcggttctccaagctgagcctggaagactcgggcatgtaccagtgtgtggcagagaataagcacggtaccatctacgccagcgccgagctagccgtgcaagcactcgcccctgacttcaggctgaatcccgtgaggcgtctgatccccgcggcccgcgggggagagatccttatcccctgccagccccgggcagctccaaaggccgtggtgctctggagcaaaggcacggagattttggtcaacagcagcagagtgactgtaactccagatggcaccttgatcataagaaacatcagccggtcagatgaaggcaaatacacctgctttgctgagaacttcatgggcaaagccaacagcactggaatcctatctgtgcgagatgcaaccaaaatcactctagccccctcaagtgccgacatcaacttgggtgacaacctgaccctacagtgccatgcctcccacgaccccaccatggacctcaccttcacctggaccctggacgacttccccatcgactttgataagcctggagggcactaccggagaactaatgtgaaggagaccattggggatctgaccatcctgaacgcccagctgcgccatggggggaagtacacgtgcatggcccagacggtggtggacagcgcgtccaaggaggccacagtcctggtccgaggtccgccaggtcccccaggaggtgtggtggtgagggacattggcgacaccaccatccagctcagctggagccgtggcttcgacaaccacagccccatcgctaagtacaccctgcaagctcgcactccacctgcagggaagtggaagcaggttcggaccaatcctgcaaacatcgagggcaatgccgagactgcacaggtgctgggcctcaccccctggatggactatgagttccgggtcatagccagcaacattctgggcactggggagcctagtgggccctccagcaaaatccggaccagggaagcagccccctcggtggcaccctcaggactcagcggaggaggtggagcccccggagagctcatcgtcaactggacgcccatgtcacgggagtaccagaacggagacggcttcggctacctgctgtccttccgcaggcagggcagcactcactggcagaccgcccgggtgcctggcgccgatgcccagtactttgtctacagcaacgagagcgtccggccctacacgccctttgaggtcaagatccgcagctacaaccgccgcggggatgggcccgagagcctcactgcactcgtgtactcagctgaggaagagcccagggtggcccctaccaaggtgtgggccaaaggggtctcatcctcagagatgaacgtgacctgggaacccgtgcagcaggacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacatctcctggactttctcaagctctagtcttagcattaagtgggaccctgtggtccctttccgaaatgagtctgcagtcaccggctataagatgctgtaccagaatgacttacacctgactcccacgctccacctcaccggcaagaactggatagaaatcccagtgcctgaagacattggccatgccctggtacaaattcggaccacagggcccggaggggatgggatccctgcagaagtccacatcgtgaggaatggaggcacaagcatgatggtggagaacatggcagtccgcccagcaccacaccctggcaccgtcatttcccactccgtggcgatgctgatcctcataggctccctggagctctgatcctggaacccctccctctgcgccgcagctggacgccacctccgacggacacagccagccccttcctgctgccaaggtggcctgacactgtgccagagagtggctggttttaaatacctactttaaacagtgccctttttgtaggaggtaggatattttatattctgccgcaggatagaacccacgcaaggattttctttaaattgagaggcaccaggcagtaacttccatgatgacactgacgcctatacctgagctctaggctgcctggagggaaggaacaggcccatgggaagaagggggttttaaaaacatgtcttcaactcagcagagatggccctctgggaccctatacggactccgccacttgagagcagtcctaggcccggcaggaacaccagacatgaacaggttgaagaactggagcgaagtgcacacctcaccatccttcagtctaaggaagaagggcaagccctgggaccaagagctctcccgccttctccctcgagcagcagcaaggaccctgacgctgtccccgataactccctaggggctcctgcctgcccaagcggctgagaaccagcgccccgatgcctgaggctgggagcctgagccccttcagctttgaggggggtgatactccaggctgtttggggtgggagccaaaaagagttgagaggccagggcccttggtggaaaggggcaccagccttggtctgagatagtcacaacccaggtgacgatgccctctcagccaacactgccaacctgaccctgtcatcccgattgacagcgccacttcaggtggctgggtgactaaagggcttgtcttggtggggtctcccacccctccaagacccattctgcacagtccctccagggtttgggcaggagatggccaatcatgcgcccacctctccagtgctgcctgcagtcagctcggcctccccgacctgcagccccagactctgctctcccagcactgactcactcctgcctgggaggggaatgcagcattcatgctgtgtgtcctggtattgggaggtttctgggaagggcagaggataaatgtggccctgcctgctcccaggtatacctaggaccacctggccagatccgctcccagacggccttggactgcttgcatttccccggagaaaaaggggttaataaatgggccatcctttcctgagctctgggtatactaccagtcacagaacgtcagagctggaagaagccttagagctcaacttcttcaagcccctcactttacagatgaggaaatggaggtggtccagagagggtctgggattcccaaggtcacacagcccagaagagatggggctgggttaagaactcgagtcttccacctttctgttcaaggctgtttgtctacccagaggaaggaggcactgctgaatggctatggcctggctaagaaggtgattagtcagtagggtgtgaaaattctacttcaaggggttcggattggtgatcatggggattggcatggctgggttcccgtccaaggtgtgggcagagcttctaccaaacttcaacatggagggctgacttgaagctccctgtccccctcactcttgccccaagaaaagaggccaaagcaagagcagattccctaggcaagagcagcagcacaactaggaaaccccaaagcccatgctccgacaggtggcccttcacagggggcagcgggacaggcatcttgaagggcatatgtcctcggaagctccgagcctgttttctgtagtttatagttagagctctattttgttatggttttttaaacttttaagtcctgctctattttcctgggcaggtttatgttgatgtttacccactacaattttttaaaaatataagctcacatgccttttccctgccacagccaaacccccactgcaccctacccacccacccctagcccaggtcagctttcctggagctggctaatgaaagcctcctcacctcttcccaacccttacaagcaagggtgctaggggctcagctatacgaccattctccctgacagggagtccaaacttggcctagcatccctcctggcccccctctggccacgacttggcctgtgcctggttctctatcagaaaggggatgctgaacaaaacctccttccaagttttatccaattcgttcctcattgcctcgggctgcgtcaggggaagcaggggacaggtgtccagttgctgggccgagggaggagctggtttggcataggacctaaccagtgaagctagaggctacagccactaaacttgcttcaggccaacgatagttactcacaagtaagtaccttaatgctaatgaggtccactaaaaaggggaggaaggcagacctcctgggagacccacgaagggtttttagccagggaaaactgagccccaggaaaacctaaccactgggcaggcagaatttgtttgagggatagaacgacaacaaaataaatgttcctgcagcctgagatttcaggtagagtactgactaaggtttaataagacaataggtgacctgaggacatgcaagcttgtaaaatgcaacagcctcctgctagagtgacttgtacatgagcttgcttgcagaagactagattagatgtttctcaggatcccctcctgcgcaggggttctctgattttcgtgttctctgcccagatgggctgggggagttgagagtgtgcttattttcactgcgatcatgagaccacagttctgggttatctcctctcatacatcaagccccagaggaggcggcaagaggaacagccacaaacaagtactttaccccacagcttagtggccagtaaacaccctggggactaggaaaaggaaccaactgtaggcacctctccagggcctagggagacaagtgtcctctcttctgcatacatttgggctccccttacagagccctttgccctggctctctggtccttgttgctctaacagtccagatgtacacccagcctcagggggaaggcagctctctccagacagagtctcagggcccagcaaggtcaggttatctgctttcattcagggcaacaaatgatacaaatggtgccagggagtggcaaggccatgggggtaggtgggggtgtctttttcttttcataaagtaacaacagacgagactgaggttaaacatcagaaaaaaacctctggaatgaccttcctcattccaggaggccctggaataaggaagaggcttctttctgagggagctttgaggaattttgacagctgttgacatgggatttgggaaaggtgaagctgtgactggaggggcaggagatggtccaagtgtccatccagagatgagactcttagaatcaaagtgttcagcccaggaagtcttggagatcccaccttctgtggccctgcaccttatgggaagccattaagggggctcatctaggaattctggttacagcccagtgctcatcccagcgtatgctgcctctttagggcagccccaagggccagccagcctgtactctgggcaagagcccaaaatggctaggaatgtttgactcccttaatctcttccccagctacagaggaatcttttctctgcctggtctcagaatgggactgccaactggctcattggtgggagacacagtatcctcaaacctgtggccactggcatgacagtggtgctctgtctccctgggtgacacccaccctaggcttcctcctggatgtgatggggattgccagagaggctcttagcataaaaggcattaggtgggcatttttctgtgtgcccccaaaaagctccatggaaacaggcacctggtagctgcggaacacccgtggacttgtgtatatggtcataggctttgggaagacaggacgtaaaggaaaatgagagaaacaaaatgggtcagatagctttggccacagccccaggcagcctttggggcctatgacacttagtgcccttagatgggatacatcttgcctcggccccaagactcctccaacttacccgtcccatccagggcctgcacagcttagagaggctcacagcttggcaaatgctagggcttcatcagaccactgacttgactcagtgtttgttaaaatggaaccactcccgttggcctactgtttctctcctgtacttcttgtaatgatagttatttattgactctggtagcaggcagttcttaaataaagatggtttctcaacctgttggggaagctggcacgagctgtgggtgttatcatcaggctaaagcatacctccttgtcctgttcttcactccagaggcttttatccaagaatttctttaccccccacacagtgaaatataagtaagttacaacatacagtctatattgcttcatccagtcccaggaggagggaaaaattaggccaagatcttaaggcaggtccaagcagagcacaggcaggcatttggctagaatcagttggctttacctaatacagtggcagtaaacaatgcttatgtgatggtactgcttcaaggtggcctgatttttaagacatctttgaggtgttgactcagtggtcccaaaggaaagtctccctgcagatatattaatgatacccaactggtgagaacgaggctgctgcctctactcttggttcacagcagccacaagggtgtgaattactagtcactttccagccacactttctcacacattcgataaccatttatcaaa

SEQ ID NO: 6743 - DNA, 4948 bp, Homo sapiens
gagttactcttgcatttggcaattaaagatgatgtttccatggaaacagttgatcctgctttcattcattggctgcttaggaggtgagcttctcttacaaggccctgtatttatcaaagaacccagcaacagcattttccctgttggttcagaagataaaaaaataactttgcattgtgaagcaagaggcaatccatcacctcattacagatggcagctgaatggaagtgatattgatatgagtatggaacatcgttataagttgaatggaggaaatcttgtggttattaatcccaacagaaattgggatacaggaacttaccaatgttttgcaacaaattcacttggaacaattgtcagcagagaagccaaacttcagtttgcctatcttgaaaattttaaaaccaaaatgaggagtacagtgtctgtgcgtgaaggccagggagttgtgctgctctgcggccccccaccacactctggagaactgtcatatgcttggatcttcaatgaatacccatcgtttgttgaagaagatagtcggagatttgtctcccaggagacagggcacctctacatatctaaggtggagccgtctgatgtgggaaattacacatgtgtggtgacaagtatggtgacaaatgcccgagtgctgggctctccaactcctttggtgctacgttctgatggtgtgatgggtgaatatgaacctaaaatagaagttcagtttccagaaactcttccagcagctaaaggttcgactgtgaaattggaatgttttgcccttggaaatcccatacctcagattaattggagaagaagtgatgggctgccattttccagcaaaattaaattaaggaagttcagtggtgtgcttgaaatccccaacttccaacaggaagatgcaggttcctatgaatgcattgctgagaattcacgaggaaaaaatgttgccagagggcgtctcacttactatgcaaagccccattgggttcaactcataaaggatgtggaaatagccgtggaggacagtctttattgggaatgcagggcaagcggcaagcccaagccttcctaccgatggctgaaaaatggagcagccctggtgctagaggagagaacacagatagaaaatggtgcccttacaatatcaaacctaagtgtgactgattctggcatgttccaatgcatagcagaaaacaaacatggccttgtttattccagtgctgagctcaaagttgttgcttctgctccagatttttcaaagaatccaatgaagaagttggttcaggtgcaggtgggcagcctggtcagcttggattgtaaacccagagcctccccaagggcactctcttcctggaagaagggggatgtgagcgtgcaggagcatgaaagaatttctttgttaaacgatggaggactcaaaatagccaatgtgactaaagctgatgctggaacttacacctgcatggcagaaaaccagtttgggaaagcaaatggcacaacacatttggttgttacggaaccaacaagaataactttggcaccatctaacatggatgtttctgttggtgaaagcgtcatattgccctgccaggtacaacatgacccgctgttagacatcatctttacctggtatttcaatggggcccttgcagattttaagaaagatggatctcactttgagaaagttggtgggagttcatctggtgatttaatgatcagaaacattcagctgaaacacagtgggaaatatgtttgtatggtgcaaacgggggtggacagtgtttcatctgctgctgacctcatagtaagaggttcacctggaccaccagaaaatgtgaaggtagatgaaattacagacacaacagcccaactctcttggaaagaaggtaaagacaaccatagcccagttatatcctattctatccaggctcggacacctttctccgtgggttggcaaaccgtcacaacagtgcctgaggtcatcgatgggaagacgcacacagccactgtagttgagttaaacccatgggtggaatatgaatttcgggttgtagccagtaacaaaattggaggtggagaaccaagtttaccctcagaaaaagtaagaactgaagaggcagttccagaagtgcctccttctgaagtcaatggaggaggcggaagccggtctgaacttgtgataacctgggatccagtccctgaagaactacagaatggtgaaggttttgggtatgttgttgctttccgccctcttggggttaccacctggatccagacagtggtgacatcccctgacaccccaagatatgtctttaggaatgaaagcatcgtgccatattcaccatatgaagttaaagtgggtgtttataataacaaaggtgaaggaccatttagcccagtgacaacagtgttctctgcagaagaagagcctacagtggccccatctcaagtctctgcaaatagcctatcttcctcagaaattgaggtttcatggaacaccattccttggaagttgagcaatggacatttactgggctatgaggtgcggtactggaatgggggtggaaaggaggaatcatccagtaagatgaaagtggcaggaaatgagacatcagccagactacggggcctgaagagcaacctggcctattacacggctgtccgggcttacaacagtgccggcgctgggccttttagcgccacagttaatgtaaccaccaagaaaacgcctcccagtcagccaccaggaaatgttgtttggaatgccacagacactaaagtgttacttaattgggagcaagttaaagccatggagaatgagtcagaagtaacaggatataaagttttctataggactagcagtcaaaataacgtacaagtactgaacacaaataaaacttcagctgaacttgtgctgcccattaaagaggactacattattgaagtcaaggccacaacagatggaggggatgggaccagtagtgaacagatcaggattccacgaataaccagtatggatgcaagaggatccacttcagccatctcgaatgtccaccctatgtcaagttatatgcctatagtactgttcttaattgtatatgtcctgtggtgatattaactcctttttattatttattggaaagttatttggttaccaaaaaaagtgctttcatgaaatgcagtgattatgcatgtttttttcaactcttatttttaactttctacttcattataggtaaatatgaatataattaaaaaaacagtaaatccttttaggggaatctgaaatgccttaatattaacttgataaaccaaaggaatttacatattacatacttcagacttttgatataaatgttcttaaactatgagtttaagcactgcctatggataaagactcacacactctcacatgtacacacacacgcatgagaatttctttttacattgaaaaactctttcatttaattcaaatgctattttcccattataatagcattatttggaagacttaaccagtatcaatttgaaatgctgatttaagtccccaaggatgaaaaatacattttaaaaattattttgttggagaggagtggcatgtgattcaaaagagcattgttggaaaatgctactgtggggcttagaagaatgatgtttggtttggtatgctgctaactagttgtaagactttacaaatcactttgccatctgtacctctcaattattcctctataaaatatggagataataatacctatctgatcagactttgccccatgaattagtttttaaaagataaagactgaagtatgaaagtgcttttgtcaccccaaatgcaattgacccatgcaaaatattagcatgaatttatttaatcacataaaagtcatgaagaccagccagattttcaagcttcattctgtttcattcagttatattccaaaattcaaatgatcacattttattctttctcaaaaaaaaaaagtttttttaaattaaaaaaggaattgtttccttcacagctatgaataagctttcaggttttattaaaacctagaggaaaaaatcaggaatgacctgaatctcaacccaaatattaaacaaaatccacataatccctcatttcaatttccaattccattaagggaccctctctttttggatggcagagatggttttttaatgaaatcccaccatctatctgagtgagtctggcaggctttttagttcctgagttaaatttgtaatagaaccaaggcaatgctgctgactttgatatgtatgactcagtctttcaatatgtggttttcaaaaaattgttgaagacgtgacttcatagcaatatatagagaataaattaaaatcagcagattgagttttcaacattgcaaaatcagttttttacctctttcctaccaatttcacattttgcagaaacttgttcacatttccaacaatatcagaattagaaaacagttcagataacaagaaagattaaaaattagggaaattctgatatcaccataaagcactattttacatttagagattacatttaagataaagtcatcatacacaaaaacaataaatatttataactttctctataaggtccgcatatactgtatatattgaaacaatctgaatgactagtagatttcatatgaccattgttatttccactttctccaatacttgtattttatgctacatgtaatgaagttggacctttttattatttagtaattcctatatgttcctatacttttcattttcaagatgattgctctattgtttcatgttgtttctagcaatatatctccatgagatatgcactttgtttcatattgaaaagtataaaatttatctttcaattcctgtgtgtgtatcctatggttatctgtatgtattattttctattctaataaaatttataacaagcaaa

SEQ ID NO: 6744 - DNA, 2846 bp, Homo sapiens
aatttgagcattactcaatacatgttacatagtgcctgacacctgattagcaaactataaatgcttagcccttgacttaaagagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttcttt

SEQ ID NO: 6745 - DNA, 2322 bp, Homo sapiens
gttctatgttcccagtgggaacataccagatggaggctttgatttgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttcttt

SEQ ID NO: 6746 - DNA, 5198 bp, Homo sapiens
gccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 6747 - DNA, 5093 bp, Homo sapiens
ctgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccgaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatt

SEQ ID NO: 6748 - DNA, 658 bp, Homo sapiens
agccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagctt

SEQ ID NO: 6749 - DNA, 4985 bp, Homo sapiens
agtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttatcttgacaactttaaaacaagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 6750 - DNA, 2279 bp, Homo sapiens
tagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctctccccgaagtcacaccagcgaatgtcagtggtggcggaggcagcaaatctgaactggttataacctgggagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaagaacccaccaaaccaccagccagtatctttgccagaagtctttctgccacagatattgaagttttctgggcctccccactggagaagaatagaggacgaatacaaggttatgaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccaccaccaagtcaaccccccggaaacatcatatggaattcatcagactccaaaattatcctgaattgggatcaagtgaaggccctggataatgagtcggaagtaaaaggatacaaagtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaaatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttcttt

SEQ ID NO: 6751 - DNA, 566 bp, Homo sapiens
aagtagggagctttcgccgccgccccgggcccctcggactgtgccggcgccgcacccgaggctctcgccagcccggcgccccggtgctgagtgggtgaaaaagaacagtgtgtcatgaagacaggcacctggaggtgatttgggtggcattcatgagaaaattcacgttacccacttcgctaactgatgaaacactgccagagcccacttggactgtttcgcaactttacttaagggaataaaagctctcatgctgaggaatcattgacatagagtaactccacagcatgtgtcttcaagagcttccctaaaagattaaaggttatacaaaacttaaaagaagcagcaattctattcgcttgttattggacttgaaactccctttgacctcggaaactgaagatgaggttgccatgggaactgctggtactgcaatcattcattttgtgccttgcagatgattccacactgcatggcccgatttttattcaagaaccaagtcctgtaatgttccctttggattctgaggagaaaaaagtgaagctcaattgtgaagttaaaggaaa

SEQ ID NO: 6752 - DNA, 3303 bp, Homo sapiens
atggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtga

SEQ ID NO: 6753 - DNA, 3679 bp, Homo sapiens
aaacagggcactctttaatgaagaaacaccagagctgttaaacacattgagacacagaagattctagtgactgaggatggcttcctcttggaaactaatgctgtttctgtcagtcaccatgtgtctttcagaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagata

SEQ ID NO: 6754 - DNA, 6258 bp, Homo sapiens
gaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgactttta

SEQ ID NO: 6755 - DNA, 3800 bp, Homo sapiens
gaactgtgctgatgggcaggaggatgggagacaggaattgagagtcacagaggaaggacagtggagtctggcatcttattgggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatt

SEQ ID NO: 6756 - DNA, 4303 bp, Homo sapiens
aattcgcctctgccacaggctgcaaaggacccgaggaaccgctctctctgaactgtgctgatgggcaggaggatgggagacaggaattgagagtcacagaggaaggacagtggagtctggcatcttattggtgtctttaaaggattgccatttaatgccattcaagatctactaagcatcatttttgcatgactactgcaaaaggattactttacagataccagttcctttgtcaagagcatactttggaccctgttttcagaaagcagggcactctttaatgaagaaacaccagagctgttaaacacattgagacacagaagattctagtgactgaggatggcttcctcttggaaactaatgctgtttctgtcagtcaccatgtgtctttcagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatgaaagtgtggactatgggccagtttttgtgcaagaaccagatgatattatttttccaactgattctgatgaaaagaaggtagcattgaattgtgaagttcgtggcaatccagttcccagttacagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctatctgggaaattttagtggccggacaagaagtgcagtctctgtgagggaaggccagggtgtcgttctgatgtgctctcctccgccacattcaccagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtgtgatgggagaatatgagccgaaaattgaggtccattttcctttcacggttacagctgctaaaggaacaactgttaagatggaatgctttgcacttggcaaccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacacctacccacactgggtagaaaaactgaatgatactcagttagacagtgggagccctctccgatgggaatgtaaggctactggaaaacccagacccacgtatcgttggctgaagaatggagtacccctctcacctcagagtagggttgagatggttaatggagtattgatgatccacaatgtgaatcaatcagatgctggaatgtatcagtgtttggctgaaaataagtatggagccatttacgctagtgctgagctgaagattctagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaagaatagctattcttccagacgggagtctacggatcctaaatgcttccaaatcagacgagggaaagtacgtttgccgaggggaaaacgtctttggttctgctgaaattatagcttcgctatctgtaaaagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggcccaagcatcctctgcagatttaatgatcaggaacatccttctgatgcatgctgggagatatggctgcagggtacagaccacagcagacagtgtgtcagatgaggcagaacttcttgttaggggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaa

SEQ ID NO: 6757 - DNA, 3814 bp, Homo sapiens
aagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctactcttgagatactgactggaagatagactgttttgttccacctgattgtatgggagaaatttttgaccttagaaagtggaaatgaggttgctatggaaactggtaattctgctgccactcataaactcttctgcaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 6758 - DNA, 4513 bp, Homo sapiens
aatgcagtgaaaccagaggaagaaaaaaattacttcctttcctgttggaaacctaataagtagttagtctgacccagttttcaataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctgactcttgagatactgactggaagatagactgttttgttccacctgattgtatgggagaaatttttgaccttagaaagtggaaatgaggttgctatggaaactggtaattctgctgccactcataaactcttctgcaggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaacacttttgaattttaaaatccgcacatgattacatgaattcctaggtgccacattaacctggggagttgtaactgctgtgtcttttaagttacttatatggagaaaataaataactcccctcaatgatgctgatgatgaatacaaacttggctcctagttaccataactcacatgtacatttttatgtattccagacaatcacttcagtatttaaaatttccaccctacttcaaaataaaatacaattatttgtttatagttgggattctttaaaaatacaaactattccaaagcatggggtgcttttatctctgaatcaagttggaataagaaatctttttactcaagaatatttcaatatacatgatgttcttctcagcccacttttcagaagattcagtcacaataaaggcagaaaaagtattttatggcaaagaaaaataaatgatgggaaatgagcacccacctaaaataatcttctaacaactctggtatatattaagcaattgctcatggcaaagttgaacatttgaactgctgcatgaacaaatctcaggtaattatgacaagttgattgcaatgtatgtggccttatttttataataaaacaatgtggaaacagaa

SEQ ID NO: 6759 - DNA, 3519 bp, Homo sapiens
aataagagagattttctgatgacccgacaggagtgactatctccagtcaaagaaagaggagggtgaatttaatctttcatggccctggaatggcagctgctctcagctctctctgattctgtgaaggttgatgaagatagagctggctttcaatgtagaaagaattttccttttgaatattccaaacgagagctttgcacatgtgcctcaagaactgattgtctggctccgacaggaatgcagcaggagaggagcgtatttcatgcttaagaccagagaagagccacgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtgatggtcttttaagccgtcctatttttactcaggagccacatgatgtcatttttcctttggatttatcaaaatctgaggtcatcctgaattgtgctgctaatggttacccttcgcctcattataggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatatattgaagactttgaaactaaaacaagaagcacagtatctgtccgagaaggtcaaggtgtggtgcttctctgtggcccaccgccacattttggagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtgtgatgggggaatatgaaccaaagattgaagtgcgttttcctgaaactatacaagctgcaaaggattcatctgtaaaactggaatgttttgcccttggaaatccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatgctcctccagaatgggaacagaaaatccaaaatacacacctctctatctatgacaacttgctctgggaatgtaaagctagtggaaagccaaacccttggtatacatggttaaaaaatggtgaacgactcaacccagaggagagaattcaaatagaaaatgggacactcatcataacgatgctgaatgtgtcagattctggtgtgtaccaatgtgctgcagaaaacaaatatcagataatttatgcaaatgctgaattgagagttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaagaatatttctcttggaggatggcagcctcaagatatataatattaccaggtcagatgctggatcatatacatgcatagccacaaatcagtttggcactgcaaagaacactggcagcctcattgtaaaagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagaatctgttggggatttgatgataaggaatattcagttacatcattcaggaaaatatctctgcacagtacaaacaaccctagaaagtttatctgcagtagccgatatcattgttagaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcagtccctgttgtggcaccagtaaacatccatggaggtggaggaagtcggtctgaactcgtcattacgtgggagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatgaacctcaactggccccaaggggaacttctctccagagtttttctgcttctgaaatggaggtttcatggaatgctattgcctggaatagaaacactggaagagtgctgggctatgaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcctccaagccaaccaccagcaaacattgcctggaagctgacaaactctaaattatgcttgaactgggagcatgtaaaaaccatggaaaatgagtctgaagttttggggtacaagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtttgagttccagaggaattcaattcttagaacctagcacccattttctttccattgtcattgtgatttttcactgttttgctattcagccacttatctgatgaataaaaccataaatctttgag

SEQ ID NO: 6760 - DNA, 9894 bp, Homo sapiens
acaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaaaa

SEQ ID NO: 6761 - DNA, 1944 bp, Homo sapiens
taagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccg

SEQ ID NO: 6762 - DNA, 2036 bp, Homo sapiens
aagaagctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagaattctgattttttatgtcagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaa

SEQ ID NO: 6763 - DNA, 4061 bp, Homo sapiens
agagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactacaagagctggatttccattactcactcttgctcttacattaaagttgttgattaaa

SEQ ID NO: 6764 - DNA, 1657 bp, Homo sapiens
tcgccgctcgcgaggacctcaggtggatcgccgcggcccctcctcccagagcggcagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttgaacatta

SEQ ID NO: 6765 - DNA, 1009 bp, Homo sapiens
cagccttttcccgcgcgtgctgccttcgccgctcgggccgcccgggggaaaacatggcgtctgccctggagcagttcgtgaacagtgtccgacagctctcagctcaagggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagagacagagtctcgctatgttggccaggttggtgttgaactcctggcctcaagcagtccttctgcgtctgcctcccagagtgctgggattacagcctcttagcaatgcataccacgagttagcacaagtgtattcaaccaacaacccctcagaactccgaaacctggtgaataagcacagtgaaaccttcactcg

SEQ ID NO: 6766 - DNA, 831 bp, Homo sapiens
gcgagtccgttctgggtgtcttggctctatggctcgcctctgccagctcctccgctgccaggcggcgcacgctcgggaacctgtgcgcctattttggtcctacagaatgctgcggaagctctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcatt

SEQ ID NO: 6767 - DNA, 1613 bp, Homo sapiens
gagtccgttctgggtgtcttggctctatggctcgcctctgccagctcctccgctgccaggcggcgcacgctcgggaacctgtgcgcctattttggtcctacagaatgctgcggaagctctcgctcggcaaatgacacagctttgtgaactgatcaacaagagtggggaactccttgcgaagaacttatcccatctggacactgtgctcggggctctggatgtacaagaacactccttgggcgtccttgctgttttgtttgtgaagttttctatgcccagtgttcctgacttcgaaacgctattctcacaggttcagctcttcatcagcacttgtaatggggagcacattcgatatgcaacagacacttttgctgggctttgccatcagctaacaaatgcacttgtggaaagaaaacagcccctgcgaggaattggcatccttaagcaagccatagacaagatgcagatgaatacaaaccagctgacctcaatacatgctgatctctgccagctttgtttgctagcaaaatgctttaagcctgcccttccatatcttgacgtggatatgatggatatctgtaaagagaatggagcctatgatgcaaaacactttttatgttactattattatggagggatgatctatactgggctgaagaactttgaaagagctctctacttttatgaacaggctataactactcctgccatggcggtcagtcatatcatgttggaatcatataaaaagtatattttagtgtctttgatattacttggcaaagtacaacagctaccaaaatatacatctcaaattgtgggtagattcattaagcctcttagcaatgcataccacgagttagcacaagtgtattcaaccaacaacccctcagaactccgaaacctggtgaataagcacagtgaaaccttcactcgcgataacaacatggggctggtgaagcaatgcttgtcatctctttataagaagaatattcagaggctaacaaagacctttttaactctatcattacaagatatggcaagtcgtgtgcagttgtctggacctcaggaggcagagaaatacgttctgcacatgatagaagatggtgagatttttgcaagtattaaccagaaggacggtatggtcagtttccatgataaccctgaaaaatataataacccagccatgcttcataacattgatcaggagatgctgaagtgcattgagctggatgagcggctgaaagccatggaccaggagatcacagtgaaccctcagtttgtacaaaagagtatgggctcacaagaagatgattcaggaaacaaaccatccagttattcttgaaactaacatccatcctgagctaaacaagagaaactaccatcttggccagtgacaagtgttcggagggcagcagagaggaccaagcctgtgtcacctggagactaagaaattaagttttgttttgacatcttcagtcctgtgtgctttcagaaaaccattttctctgcaaagaaaggaaacagatttgcaaactttaaagtctgtcgtggatttatttatcctcagattattgttactgcattaaatctacctttttgttttaagttgcttg

SEQ ID NO: 6768 - DNA, 4760 bp, Homo sapiens
tatgacttttaaaattcatgaatttgaataattcatcagttttctcagaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctccacagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacagagtagtgtgttttcatttttattctttacatgtgaccaaaacaatagaaaagttaaaaataaaatatagtgttttaggtggc

SEQ ID NO: 6769 - DNA, 580 bp, Homo sapiens
gaatcctgcggtcccagcgtcgctccggacgctgccaacctgttctccaccgtcgctcgacttccacctctaagactcccacgtgagtgcgggcgtctcccagttcctgggccggaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagag

SEQ ID NO: 6770 - DNA, 278 bp, Homo sapiens
agccctaggttctcctgaatcctgcggtcccagcgtcgctccggacgctgccaacctgttctccaccgtcgctcgacttccacctctaagactcccacgaaactcaggttgaataattcatcaaattacacaactgggtcttgctctgtcacccaggctgcagtgcatagcttactgtggcctcgaactcctgaacttgagtgagcctcctgccttagcctactgagtagctgggactacagaactcaagacatggctgcccagtgtgtcacaaaggt

SEQ ID NO: 6771 - DNA, 4864 bp, Homo sapiens
cttgctctgccagtccagccctaggttctcctgaatcctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgacaaaactgaaagaagcctccagaagctcacctgttgaatttgaatgcataaatgagaaaaaaaggcaaaagaaaaaaagctacaagaattcaggtgttatcagtgtgaaacagtgtgagattacagtagaatgcacattccttgactatataatgggaggatgtcagctgaattttactgtgggagtggacttcactggctccaatggtgacccaaggtctccagactcccttcattacatcagccccaatggcgttaatgagtatttgactgctctctggtctgtgggactggtcattcaagattatgatgctgataagatgtttccagcttttggttttggcgctcagatacctcctcagtggcaggtatcacatgaatttccaatgaacttcaacccatccaatccctactgcaatggaatccaaggcattgtagaggcgtatcggtcttgtcttcctcagataaaactctatggaccaactaatttttctccaatcataaatcacgtggccaggtttgctgctgcagccacgcaacagcagacagcttctcaatattttgtgcttttgattattactgatggtgtgatcacagaccttgatgaaaccagacaagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaagcagtgaccacttcaacagaattcttttgtgttatgtggagcaatgccatctctcaccccaaatcgtgtatctgtcattctacgtactttttacccccagcatttatgatgtaaatctctttctctatggattatatctgtttaaagcattctttctaggttattttggggggacagtgccaagtccatctttgcccagtcaattcagtgattgatagcaatttacattaattgcagtaaagctctttggattagaaattagtgtggggaaagcttattctgttgttgtttttgtttactttcatatgatgaaaatgctgtgtttaagtgtttgtcaataggaagaatggaaaactgttgggatgatgtggtttgcaggttgctgtgcctgattcacagtgtatgttgtataagccaatgtccatacctgattatgagagcttcttaaattatatgatatcaaatttgttcctgtaactctgtatacagtgcttttctgcaaggtaaaaataacctgtctatgcatctgatttttgctacagtttagacactgtggtttacaaaacagcatgcactcaacttgggactttatgaaaagtactgaatgagcaggaaaaggcacatactcagttttttaaatgtacaatcaacaagtaaaaataacctcatgtaagtaagccatttttatttgcctttctagatattttattttattgtggaaaactgtaaacatggtcagatttggctttttttttcattaactgagcaagactttcaggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctccacagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacagagtagtgtgttttcatttttattctttacatgtgaccaaaacaatagaaaagttaaaaataaaatatagtgttttaggtggc

SEQ ID NO: 6772 - DNA, 446 bp, Homo sapiens
gttcctgggccggtgaggcagcagcccagcaaccgtaccgcccgggggaaaaggaaagtcctggcctggaggatccgagcccgcaggctccgtgcggcaggtcccgccgggccctgctgctggaagtgctccgtgggcttcgcgcagctggggatcggcaggaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtt

SEQ ID NO: 6773 - DNA, 679 bp, Homo sapiens
agtccagccctaggttctcctgaatcctgcggtcccagcgtcgctccggacgctgccaacctgttctccaccgtcgctcgacttccacctctaagactcccacgaaactcaggttgaataattcatcaaattacacaactgacggagtcttgctctgtcgcccaggttggaatgcaatggcgtgatctcactgaccgaaacctccgcctctgaggttcaagtgattctcctgcctcagcctcctgagtagctgggattacagaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaa

SEQ ID NO: 6774 - DNA, 816 bp, Homo sapiens
cagtccagccctaggttctcctgaatcctgcggtcccagcgtcgctccggacgctgccaacctgttctccaccgtcgctcgacttccacctctaagactcccacaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataaggatctatttggaaagtcagacccatacctggaattccacaagcagacatctgatggaaactggctaatggttcatcggacagaggttgttaaaaacaacttgaatcctgtttggaggcctttcaagatctctcttaactcactgtgttacggagatatggacaaaaccattaaggtggagtgttatgattatgacaatgatgggtcacatgatctcattggaacatttcagaccaccatgaca

SEQ ID NO: 6775 - DNA, 656 bp, Homo sapiens
ctccaccgtcgctcgacttccacctctaagactcccacgaaactcaggttgaataattcatcaaattacacaactgctaattaactattaattagaggctttagtgctctgaagggattttggcataaaggggaaaatacctgggtttatgctgtggtggtgacacttactagctttgtgatcccataactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaaattgtttccagcaagaagctaactcgaccactggtgatgaaaactggcagacctgcaggaaaagggagcattacgatttcagctgaagaaataaaagataatagagtggtcttgtttgaaatggaagccagaaaactggataataag

SEQ ID NO: 6776 - DNA, 3897 bp, Homo sapiens
gggcagatttgattttcccgcagcccgggcgccccggagccgaagcccgagccgaggaggtggcgctcgcagccgcgtctcagccccgtcgccgccggcgccaagacccagggagaggcggcgcagcccgggcgctcgggctccgcgctgccggcgccccgccacccccgccgccagcgccccatccggcgcctcccgctcctcacgcccctctccctgtcttctgcatcccctctacctctgcccacagacgcgcgtccctctcctggtgcccctctccacgactccgcgtttccctcccggtgccctctccccgagcccctctccccgcgcccctctctgccttccccgctgtgcccccgctccctgggctccttgcccttccccactgggcccctagcctcctcgcggcgtcacccgagccccctcctcgatccgcggcccccgctccctccgccctcttccctctctcacttcccacgccccctcttcgcgctcctctctcctccccttgccgcccagcccaggctctggagttgggggagagcccagggctccagtcgctccggaggaggcgtgaatcgcgcagggattgactaatttggggtggggggtgcggtgggcgatggagcagcctgaggacatggcgtcgctgagcgagttcgactccttggcgggcagcatcccggccaccaaggtggagatcaccgtgtcctgcaggaacctcctggacaaagacatgttttccaagtccgacccactgtgcgtcatgtatacccaagggatggagaacaagcagtggcgggagtttgggcgcaccgaagtcatcgacaacacgctcaatcctgacttcgtgcgcaagttcattgtggattactttttcgaggagaagcagaacctccgttttgatctatacgacgttgactctaagagtcctgatttatccaaacacgatttcctgggccaggccttctgcacccttggagagattgtggggtcccctgggagccgcctggaaaagcccctcacgataggcgcattcagcctgaattccaggacgggcaaacccatgccagctgtgtccaacggtggtgtcccaggaaagaaatgtggcaccatcatcctgtccgctgaggagctcagcaactgtagggatgtcgccaccatgcagttctgtgccaacaagctggacaagaaagatttctttgggaaatctgaccccttcttggtattctacagaagcaacgaggatggaacgttcaccatttgccacaagaccgaggtcatgaagaacaccctaaatccagtctggcaaactttctccattcccgtgagagccctctgcaacggcgactacgatcggaccatcaaggtggaggtgtacgactgggatcgggacggcagccatgacttcattggggagttcaccaccagttaccgggagctggcccgtgggcagagccaattcaacatctatgaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagt

SEQ ID NO: 6777 - DNA, 2542 bp, Homo sapiens
gaagtagatagcaatactcacccagacagaagagaccacggtaaagatcagctgacggcctctgtgggaacaaagacagggaaaggggaaatgagttcaccagaaaccaacaggcagcacaggaggtggtaaacccgaaaaagaaaatgaagaaaaagaaatacgtgaattctggcacagtcaccctgctttcctttgctgtggagtcagagtgcaccttccttgactacatcaaaggagggacccagatcaacttcactgtggccattgatttcactgcctccaatgggaacccctcacagtccacatccctgcactacatgagcccctaccagctgaacgcctacgcgctggcgctgactgccgtcggagagatcatccagcactacgacagtgacaagatgttccctgccctgggcttcggggccaagctgcccccggatggcagagtgtcccacgagttcccactgaatggcaaccaggagaacccctcatgctgtggcatcgacggcatcctggaggcctaccaccgcagcctgcgcactgtgcagctgtacggccccaccaactttgcccccgtggtcacccacgtggccaggaatgcagcggccgtgcaggatggctcccagtactcggtgctgctcatcattactgatggggtcatctcggacatggcgcagaccaaggaggccattgtcaacgctgccaagctccccatgtccatcattatcgtcggcgtgggccaggcagagttcgacgccatggtggagctggatggcgacgacgtgcggatctcctcccgggggaagctggctgaacgcgacatcgtccagtttgtacccttccgggactacgtggaccgcacaggcaaccacgtgctgagcatggcccgcctggcccgagacgtgctggcagagatccctgaccaactggtgtcctacatgaaggcacagggcattcgcccgcgtcccccacccgcagcaccaacccactcgccctcgcagtccccagcccgcacgccccctgcgtcccccctgcacacgcacatctgaacctggtctcagcaggcaggtggctggggcctgggagaggccaggtgaatgggaggccagggccccagactccccgaagttggcctgcccggcctttgggacatctgtgtgcctgggaggctgccagggggtggggcttctgaagacccctcctcaatttcttggcctcacttattgcccaaacccagggagttaggggggtacgggtgaaagaggggtacacagggacccagcccttctcttcttccccaatacctggctctaacccagccaggaaggtgtaaacaataagggtgattggggtccctgtcgcccacccccggcaatcctatttgcttacctgtcaccctgaagcctgggcttggcctcctccagccccccatctccgtcccatcctcccatggtgtctactcctgtccctgagccccgccctgtggtctatcctgtgcccgatttccagtgaaccccatgaagctgatgggtttgcaggaaggcctgaacatgtgcaccctcccagggacactggatgcgctgggagccccggggaccccatggggtgctgtaatcatggaccgtaggccatgtgatgggcctgaagtggaggctgctcagcacagagccctttctggtgcctctcgaactcagtacgatgcaagttctagacacacagatggcctgtggaggcctctccctggtgtgggcccacaggtacttccatggttgactcctggcttcaggaatcccttcctccctccagaggcttcccagggccctcggtgcccacgcctctgcccatctggaggcctgagtaaggagtggctcagccccacgttcccacactgctcctgctctttgccctgtatcccatgaggctaggagacaggagtcctgggtttgagccctgcctccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagt

SEQ ID NO: 6778 - DNA, 2009 bp, Homo sapiens
gccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcaccgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 6779 - DNA, 2235 bp, Homo sapiens
agtccttcagcagatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcaccgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagcacctcagcctctaa

SEQ ID NO: 6780 - DNA, 2130 bp, Homo sapiens
agtccttcagcagatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctggtgtatgactatgactccagtgggaagcatgacttcatcggcgagttcaccagcactttccaggagatgcaggaagggacggcaaaccctgggcaggagatgcagtgggactgtatcaaccccaagtatcgggacaagaagaagaattacaagagctcagggacggtagtgctggcccagtgcacggtggagaaggtgcacaccttcctggattacatcatgggtggctgccagatcagcttcacggtggccattgacttcaccgcctccaatggggacccgaggagcagccagtccctgcactgcctcagtccccgacagcccaaccactacctgcaggccctgcgtgcagtgggaggcatctgccaggactatgacagtgataagcggttcccagcttttggctttggggctcgaatcccccccaacttcgaggtgtcccatgactttgctatcaactttgacccggaaaatcctgaatgtgaagagatctcaggggtcatcgcctcctaccgtcgttgcctgccccagatccagctctacggccccaccaatgtggcccccatcatcaaccgtgtggctgagccggcccagcgggagcagagcaccggccaagccacgaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgcctgtcctgaccctcgtgactccagtgaccaatgcctccacctcttggaccaggtgtgccccctgggttctggacgtgagtggtgggtcctgctcctatctctcc

SEQ ID NO: 6781 - DNA, 453 bp, Homo sapiens
cagtgagtttatgtactggcgcctgtgtgtgtcaagatatgtgtgagcctgtgagtcgtgggtgcatgtgtcgccatcatttctctgtttgaatgtgtatgtgcatgccactgcaatgtgcgcatctctgcgattctgggtgtgggtgtagtgtgaaggggaagatgtgtgtcactgtgtctgtgggggtcctgcctctaagccacccccagcctgccctcctcccccggttctgtggctccctcccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagca

SEQ ID NO: 6782 - DNA, 591 bp, Homo sapiens
atgtccatttcctgtgtctccttataaaatggtggctagggaactggacatcattctcaaagctatgacgttcagcaaggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaat

SEQ ID NO: 6783 - DNA, 964 bp, Homo sapiens
actgtgtctgtgggggtcctgcctctaagccacccccagcctgccctcctcccccggttctgtggctccctcccaggctgtggccctgccccttccctcttctccctcccaatccatccacgcggggggagctggtgctgcgcccccccccacccctccccatccaggccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggcacaaacgactatgtgcaactcaccttcagagcctacaagctggacaacaaggatctgttcagcaagtctgaccctttcatggaaatctataagaccaacgaggaccaaagtgatcagctggtctggagaactgaggtggtgaagaacaacctgaaccccagctgggagccgttccgcctgtccctgcattccctatgcagctgtgatgttcaccgacctctcaagttcctg

SEQ ID NO: 6784 - DNA, 543 bp, Homo sapiens
gctgtattccgggttagtttgagtgagtacatgtgtgacaaggacagcccagtgttcctgtatatgtgactgcagatatccttagctagtgtaacaatgttgaaagtgatgtgagaagggcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgatacctt

SEQ ID NO: 6785 - DNA, 733 bp, Homo sapiens
agatgccctcatgtgaccaggatatgaggttgggtgtccttaagcaattatgtccatttcctgtgtctccttataaaatggtggctagggaactggacatcattctcaaagctatgacgttcagcaaggtatgtgatggcttttaaggagcacgggaagatcacatcctgctgtattccgggttagtttgagccccataaatagcagcagagccggagctggagccggcgccagcggctggagcagcaagggagtcagggccagggccagagagccggagagaggagcccccgaccgagagcccagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacg

SEQ ID NO: 6786 - DNA, 657 bp, Homo sapiens
agatatccttagctagtgtaacaatgttgaaagtgatgtgagaaggggccccataaatagcagcagagccggagctggagccggcgccagcggctggagcagcaagggagtcagggccagggccagagagccggagagaggagcccccgaccgagagcccaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccagattgtgtcacaaaccaaggtcactaagccattattgctgaagaatgggaagactgcgggcaagtccaccatcacgatcgtggccgaggaggtatcaggc

SEQ ID NO: 6787 - DNA, 2657 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtccttcttttttattgaggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 6788 - DNA, 2433 bp, Homo sapiens
cgcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggtgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 6789 - DNA, 1430 bp, Homo sapiens
cagcttggccacctggctgcacagcgacgccaccgtcagcttcgccagagggaaggactgcagaatccggccctcctgcggggggcgcttctgaggctctggggacgtcgtcctagtggggaagagcgacagcggacgcagcagccggtggtaaaaccgctggagctcaggctcgggcttcgggggctccatcatagagccggcggccgccaccgtccaggaacagaaagccgaggggttactaaggcaaccaggagcccgacggcccgagtgcgcctgcgcggccgccacccggtggctgacgaagcagggccttgcgtgcgcacgcactaggaggaggagttaagggtggctttagaggctcagtccccgcgacgccgcgctggttggtgctcctgcgccggaggagttctgcgtctcggggtggtgactgggtccagaatggcttcggattcggggaaccaggggaccctctgcacgttggagttcgcggtgcagatgacctgtcagagctgtgtggacgcggtgcgcaaatccctgcaaggggtggcaggtgtccaggatgtggaggtgcacttggaggaccagatggtcttggtacacaccactctacccagccaggaggtgcaggctctcctggaaggcacggggcggcaggcggtactcaagggcatgggcagcggccagttgcagaatctgggggcagcagtggccatcctgggggggcctggcaccgtgcagggggtggtgcgcttcctacagctgacccctgagcgctgcctcatcgagggaactattgacggcctggagcctgggctgcatggactccacgtccatcagtacggggaccttacaaacaactgcaacagctgtgggaatcactttaaccctgatggagcatctcatgggggcccccaggactctgaccggcaccgcggagacctgggcaatgtccgtgctgatgctgacggccgcgccatcttcagaatggaggatgagcagctgaaggtgtgggatgtgattggccgcagcctgattattgatgagggagaagatgacctgggccggggaggccatcccttatccaagatcacagggaactccggggagaggttggcctgtggcatcattgcacgctccgctggccttttccagaaccccaagcagatctgctcttgcgatggcctcaccatctgggaggagcgaggccggcccatcgctggcaagggccgaaaggagtcagcgcagccccctgcccacctttgagcaggacctcaccttggctctgttgctgtcctccagggcgagcactttccacttccagagggggccagagggactttgcctgcccagtctttggagagctcagtacagggcaggagctgctgtggtgttcccttggcaaatgaaagttttattttcgtttggga

SEQ ID NO: 6790 - DNA, 2825 bp, Homo sapiens
cgcgcagggacgccgcaggcggcgataggatccggactacagctcccagcgcgccccagttcccgcccccgcctccggagcccgacgctgcagcggctcttctcgaaaggttctttccgcctgtgcagctcgccggctcaatactccgggggtctgggtggggggctcaaacgcagggctctgggacgcaggcactgctccaggtgatagtgcgggaacatggccttgcagctgggcaggctgagctcgggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacagggctggccgcggcgctggcggggttggtggggctggccaccgccgccttcgggcatgtgcagcgggcggagatgttgcctaagacctcggggacgcgggccacttcgctggggaggccggaggaggaggaggatgagctggcccaccgctgcagcagcttcatggccccgcctgtgaccgacctgggcgagctgcgaaggaggccgggcgacatgaagaccaagatggagctgctgattctggagacccaggcccaggtgtgccaggctctggcacaggtagacgggggcgccaacttttctgtggaccggtgggagaggaaggaaggaggtggcggcatcagctgtgtacttcaagatgggtgtgttttcgaaaaggctggggtgagcatttctgttgttcatggaaatctttcagaggaagctgcaaaacaaatgagaagcagaggaaaagttctgaagactaaagatggtaaattgccattttgtgctatgggcgtgagctctgttatccaccccaagaatcctcatgctcctactatccatttcaactacagatactttgaagtagaagaagctgatggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtgtgatgattacttctttatagcccatcgtggagaacggcggggcattggtggtatcttttttgatgatcttgactctccgtccaaggaggaggtgtttcgctttgtacagagctgtgccagggctgtagttccttcttacattccccttgtgaaaaagcactgtgatgactcattcaccccccaggagaagctgtggcagcagctcagaagaggacggtatgtagaatttaatctgctgtatgatcggggcacaaagtttggcctcttcactccaggatccagaattgaaagtatcttgatgtctttacctctaactgcccgatgggagtacatgcattcaccctcagagaattccaaagaagctgaaattctggaagttctacgccatccaagggactgggtgcgttgatgcaggcagaatggctgtgcaggggtttggagggcacacgatgtgtgctccccatgccactggtcggcactttgccactgtgtggcagttacccgtgccttagtcttctccactctgcaccctacctcgtgggcagatgataacatgttttggatgctgtcagtgatgaatggtgagatggcagattgtcagagtcaattgattaaacctcatttatacttctagtgtcattttatatgactagtttacaaaataggacattgagtttccaagtattgagataagggaatataaatagtattatatgtatcaggaaatctctcatcttgtttttgtttcatgtattttttaaagttttcatttgtgccacaaaaatctgtcgtggaatatattttattttcattaattcagtgaagttgagacttcatagtaattttagaatgcaacttgaaggtaaaaattttactttgtcaatactgaagtctctgctgtaatccttatatatctttctccagagaacataatattgtcaaatagatacacatttttctaataggtatttagaagcacttgaaataatctctgcatgtgttacaattcagttatttctgtagtttgtaaactctaaagtgacattactattattttagagatgtctaagttgtaattttgatttttgtggaaccattgtttgttaatgttgggattctctgcacttttgaatgtgaaagcttatatccctgaattctgatacttaagagttttctatttcagacatctctgtgtggaagttgagactaagaataatcctagggatgtcatgaatttaggcaatgtttctcatttggaaaatgaaatgagaaataatttccttctttaaagcaagtatatatagtatgagaaacttggaggcatttcatacacacgtttcttaggaaaatggacacattgaaaatgtcctcttttttatattagagattctgcagctctttgctcttaagagcaaatcacaacaggattcttaatgtatgatttctttgttcatatattatgaatgtattattttatttgcttcgtaataaagtttataaggaagagcatctcatacatatcattatcgtggaacacgttgaatgtttgtgattctgtgtggcctttttggggctggaaaatgtatgaattcttcaactgtcttacaagagatctgctaataaattttattattaaataagactaagaaa

SEQ ID NO: 6791 - DNA, 1777 bp, Homo sapiens
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaatta

SEQ ID NO: 6792 - DNA, 930 bp, Homo sapiens
atggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactga

SEQ ID NO: 6793 - DNA, 591 bp, Homo sapiens
agacttcgggtggcggctgcgccataggcgggccacggcctggacgcgctgcggggaggggcggagcgagcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaaccta

SEQ ID NO: 6794 - DNA, 802 bp, Homo sapiens
gtcaaaatattggatttactctcagagtttctatcctgctcaatttgaattttcttcacggaagtgttttcctcaggaaagatattttattggctatttctgagttatttgagtacataagccacccagtaccttctgatcttcccattttctcttagtgtgtggctgagatatttttattctactcagccataaattggagtcagaagccttctcctttttactgttattttcacaatatttacttgctgagaatcccactcaagctgctaaaactaggcatgctctgtatgagttctactgctgttgtctgtggtttgggtggggcaaaacccactggcattctgaggctcatggggatgttttttcagttggctttctggaggatgtgaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctg

SEQ ID NO: 6795 - DNA, 6208 bp, Homo sapiens
agcgggcgggagcgcgcgctgggcccgccttggccgccgccgctgtgctgccgctgccggggaataatctgggcggcagcgggcggcctcggctagcggccacgagccacttctgcggctgcccagagaagcaaaggtcaccagtcccaagtcgtccccctctccgccccccaggaggggcgagagggagccgcagctgatgtcagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattatcatgggccttgactatattatatacttgattctaattagtcatcttttacgcaatctctgttgtctcttttctaaatgtgtttagccactcttgaataccattctccactattaacattaatttactcaaaccgttcatagcattctgtaaacatgtattttacatatttgttcccaaatttgcccattgttcattatgggtaactaataataaatttaatgctgtttcaggatgcttttcttataacagtgccactctcaggaattactaagtgacattttaaattgatattttaaactctttccaactacatagttatggtttatttcattctcatcctgttgggatgagaacttgtttgtgcctttcataacttgtttaaagcagagttttaaaattagtttataggatctgaggtggctattagttacagtggcaagattatttagaaagcaagattttgatgagaattaaaaacaatagaaaatgtagagtgcttaaacaaaaatgttatattttgaaagagtagatacttaatttataaataacagtctgaaggttggtgctattttgggataattgttttgctaatggataattctaacaatgcagaatacctagtcaagactgtcatcaaaaacattcacaaatgtttcattctatttttagtgactctgtttaaagagtttctgaaaggaaagaaattttttatttttattatctttagcagtactgagtgtcatagcagaatattttacagactttctatgagattatttttatggtacaaagtatttacatttccctcatgtttatcattatgccaattttacatggcagtcatgccactgactctgctatttagctaagtaatttcttttttcggagactgtctcactctgtctcccaggctggactgcagtggtgcgattctcctgcctcagcctcccgagtagcggggattacaggcacgcgctgccacgccccgccagttttcatatttttagtagagacagggttttgccgtgttggccaggctggtcttgaactcctgacctcaggtgatccacccaccttggcatcccaaagtgctgggattacgagcgtgagtcacagcacccggctaagtaatttctatttattgtgccaaaacatgtcaaaatcatgacctctttgaatggtatatttgagaggatgttcatttcattggttaaccatggactactctgtccacgtagtgaaaacatgcaccagtttttacctattatcatggtagtatcatctgccaaaatttcaaggcattcattttattctttgaacaactcttcaccatggtgtggacatgaattttcatatgtgttacttgactagaagtataaatggtttactatagatatccaaaaaccttgagatttgctcataggaaatgaatattgtgatgaatcctgggctctagagtcagacttgcttgggtttaaattcttgctctaacacttactgtttttgtaaccttgagcaattttaatctctctgtgtctcaatttcctcatcttttaattagggatgataatactacctacctcacaggatttttatgaggattaaataaatgtaaggtttttagaacattgatagggagcaataaatagaagattgtattattattctgttaccttggagtgtaagtactgcatttaagtgaatgaaaaatttgctttgaccagatactgaaggaaataagtaatagctagtatttatccaatgccaactgtatgctaggtactgtgcttagataatctgtgtataatagtgttaatcctcaaaatttgggtgttatacccctattatagataaggaaactgaggctcagagacaaagtaactttgtcactgtcacaaagctagtaagtaacagaggtaggatttatattcaaaaccctgtgtgttcattggaaccgtatcaggcttggggctattcatgtagcattatttccatttttatgtatatgatatatgacgtctgatgcattggccagtaatagtcaaattaacccagccaaattgtcacagtgattcttaaactgtggttctcacacttgcccaggatgttgttaaatgcagatctgaagaccccaatctcagaaattcaaatttaagcatggggcccaagagtatgcattcttaccagataccttgggcagtgactgtcaaaagtctggtcccaacaaacagcattaacgtcacctgggaacttgttggaaatgcagcctctctcggggcctcatctcagatcagatctactaaatcagatactctaggggcaggggcaggggcaggggctagcagttgtgtttaagcaaactctgcaggtgtctttcttatcctagtttgagaaccaatacccaacaacctacgtgattttggtgcaagtagtgtttgaaacacactgaagattactgcccaattactaagacatttttcaaaaagcatgttttaaatcagtgtagtccaggatcacactatattaaatataaagataacttaaaggatcattggatcattcattttggccaaatttttagcttctccaaagtgactaacatcagggcctacaataaaatctgtaattctccaagtttagtaattttatattgaggcaggaagggctcattaagtactaataagtacataatttattaaaaacatacataagtgtcatcaaaaaggtccacaattgttagtaaaaaaaattaaattgaagtagtaaatgctgttttataacatacatttttctgctaattcattctgttttgtgtgacctaataaagcaaaagaaaaataaaaaagcaattctccaagtacttcatagagcacataaaaccagatttcatgatgatgatgtattcactatcttttagattaagatctttgttatttggtaaatgatttcagtatggttttaaaacataaggcttttgatgtcttatgttctctaataatggtatgcttgtattttctagtgggaagttcatagataaagcagatttttgtcccagtttgctttcaaatataaatttcagagggctttttcttactgtaatgaggtatgaaaataaatcattgatcagctcttaatattttttgaatacagaattggatttgagcagtaaatttgctaactggttattttcacaattttcttgaatattaatttttcacttctttgagactgtcaaactatagttactaccaggttgatgcactgtacttgaaagaatcccttgattaaattacatctagcattttatttgccatttcaattttcagttcattagactataattctttgacagtttctgcctggtgtttattgcccttctttgtttgctttattactaacttccattttctagttactcttaaatgctgccttcacaaggttaatttggctgttaatagtgattagaatttttatcacttaattgataattttaagcctactaactagggttccctatgaaattgaaagtaaaagtctaagaataatgcctgctggctctcgagatacttgccctacttaaaaatctataatttaaaattaattctatgtctacaattattaaaggaagtaaagttatttgggttcttccactcacccttttctcaaaaacaacaacaaaaaacaaaactcattttatttttctactttatagtaggcctgacagaaacatagtgaagcaatctgggaggcaacctgtggtagattttatgctaaatgttaatgtaacctctgttgattttttaaaaatgtgtttatatataagatttgaaataaaaactttaatacaggctagaataaggaattttacaaattctctttagagcaaccaacattaaagttttagagttgaattttgctctatttcaactcccttacctctctagttttcagtttatattaagttttaataactttgcggggccctgcaaattaataatctacatgaagtatattattagagggaaactaatcttactgctaagcagtgtgttgtactacatagtgaatgttcgtgttttggaatttaaaaattatttaaggtaatggtgttacgaatggtttaaaaatgtctggtgacttgcttatttttaagtgatcaccattaagtcagaaaaatgtatttttaaatgtttcttgaagtgccttttgaacatttttaaacagcggatttaaataatgcataaaataaattgccatgttcaaagttg

SEQ ID NO: 6796 - DNA, 3136 bp, Homo sapiens
gcggtgagcgctggggctgcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagtaaaaa

SEQ ID NO: 6797 - DNA, 3100 bp, Homo sapiens
gcggtgagcgctggggctgcgcgggcggcaggcaacggctgaggcggcggcggcggcggcggcggcgtgggttgggctcgagcgggcggcggcgcctcagactccccggaacgggagcccacgcgggcgggcgcctgaaacaaagggaagcgggcgtccgggcgccgcgggtgggcggtcagtcggtcagcgcggagccagccagcgggtgcccgcgcaagccccgagcgcggccggccggcgcggcctcagggcgggaagatgccgcgcgtcgtgcccgaccagagaagcaagttcgagaacgaggagttttttaggaagctgagccgcgagtgtgagattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaattaatagcacagcagatgtgtgctgcccatctttacatacacattgcttctagttggcagaaataattgattaaaagaccagaaactgtgataactggaggtactacggtctatttctcaaccttaggcagtaatagacatcacaaactgccatggttttgcactatgattataatacctgcatttctaattttttaagcatgtagccagtaataatttgaagttttttttctatgcaagcttaccttgttggcattattttagggagttgaaactatcaactgtaaagctccttttcttccactttaatttaaaagttcatgtcatttaaaaacaagtcaagaaattaaaattgtatcagagggttttctctaatcattttttctatttttttttttgtacttctagatgttttggttatacagcttcattttagatgagcattcttattttttgttttgtttgccccatttccttttgtgtttttatagtctatagcattttaaaactgctgatgttgtttgcattatttacaggctaaaaacttagtagcatagagctgtctgccacagccttctgacaaagtttacagttattaaagttgcagtatccttttaaatgctagtaatcagcactctttcttttttttttttttaatagagacagggtctcgcagtgttgcccaggctggtctcgaactcctggcatcaagcgatcctcctgccttagcctcccagagtactgggattacaggctctttctttttaaacataaaagttttaaattggtattaactctgtactctgccctagattgttttagcttctgttctgtaatcatgagtttggttggagatattctccatagatgatcttctactgaaatgcctaaagaagtcacaggctggcttctgttttattcagggatttttttaaaaagtcaatcagaaaagggatactggagcttcttcatgtatgtaacagcatattaaactggagacagtgatgaatcagctacaaaggtaatattgtattaaaatcatgtttaagatagctgcttttatgtgtattttatattgcatgcttttgtaaaaacatgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgtttgtttgtttaatttactttcacaataaacttctgtgtagt

SEQ ID NO: 6798 - DNA, 7319 bp, Homo sapiens
cggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 6799 - DNA, 7737 bp, Homo sapiens
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 6800 - DNA, 7617 bp, Homo sapiens
agcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctg

SEQ ID NO: 6801 - DNA, 1416 bp, Homo sapiens
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttga

SEQ ID NO: 6802 - DNA, 7449 bp, Homo sapiens
ggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttgggttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattcctt

SEQ ID NO: 6803 - DNA, 1883 bp, Homo sapiens
gcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcaactcaacagtgacaattgaggaattccactgtaagctccaagaagccacaaactttccccttcgtccttttgtgattccatttctcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtctaaatggaggctatcaagatgagttggtagatcatcgtttgacagaaagggaatgggctgatgaatggaaacatcttgaccatgcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatgattctcagagagagttcaacagcaggccaggtacaggatacgtacctgtggagttttggaaaaaaacagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtca

SEQ ID NO: 6804 - DNA, 677 bp, Homo sapiens
tctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtgaactcaacagtgacaattgaggaattccactgtaagctccaagaagccacaaactttccccttcgtccttttgtgattccatttctcaaggccaacctgcccctgctgcagcgggaactgct

SEQ ID NO: 6805 - DNA, 575 bp, Homo sapiens
gattgagctttgaagattaggaggagaaaaagaggagctttggaatatctatttcaaataaatttggtgtatttaagaatctggattgtttataatttgggcatttgggaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcattaagcaatggcatcaaccattctcctcctaccct

SEQ ID NO: 6806 - DNA, 3502 bp, Homo sapiens
gtattttgggacttcacattcacattctcattgggctgaggctcaaacatatggaatgtgttattttgcagcgtctacattagggaaatcaagcagggcattggtgatgggaggaagtgaacaggaaccaggtaggatgatggtaagtggacagggtttaaaaacccagggcttttggcagtctgcccaaatctatgtctttagcccttgtttgtgcacctagtcttatttatttaattgcctcctggccatttacacctggatgccccagaggcacctccaccttctcacttgcctccacactagctttgtgtggactgtccatttcattgcctagctttagcattcttctctttcacctccacttccaggcccttcggtgctcccaacctttttctgcctcatcccttcctcagtgccacttattcctgcctaaattcagcctcttctatcagttcaatcattgcaccagcctcccggttgctatctctgtctttaatcttccccttgcatagaatcctttatggagtttcctttgaaaataaagtcaagccgactgggcacggtggctcatgcctgtaatcccagcactttgggaggccaaggtgggcggatcacgaggtcaagagatcgagaccatcctggctaacatggtgaaaccctgtctctattaaaaatacaaaaaattagccaggtgtggtggcgggcacctgtagtcccagctactcaggaggctgaggcaggagaatggcgtgaacccgggaggcggagcttgcagtgagcagagattacgccactgcactccagcctgggcaacagagcgggactccgtcgcaaaaaaaaaaaaagaaaataagttcaagccgggggtggtgcctcacccctataacactttaacaccaacgctttgggaggctgaggtaggaggatcacttgagcgcaggagttcgagacaagccttagcaacataaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctct

SEQ ID NO: 6807 - DNA, 4238 bp, Homo sapiens
ggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 6808 - DNA, 4033 bp, Homo sapiens
ggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgca

SEQ ID NO: 6809 - DNA, 4190 bp, Homo sapiens
agggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgc

SEQ ID NO: 6810 - DNA, 4151 bp, Homo sapiens
agggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgc

SEQ ID NO: 6811 - DNA, 4037 bp, Homo sapiens
agggcagaggacacccagttggtggccgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagtgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgc

SEQ ID NO: 6812 - DNA, 526 bp, Homo sapiens
agtgcccgtgtctccacacgtctgcctccatcactgccatcgcgatcctgcagctatgtcctaccctgtgaccagtcagccccagtgcgccaccaccagctgctaccagacccagctcagtgactggcacacaggtctcacggactgctgcaacgacatgcctgtctgtctgtgcggcacttttgctcctctgtgccttgcctgccgcatctccgacgactttggcgagtgctgctgcgcgccctacctgcccggaggcctgcactccatccgcaccggcatgcgggagcgctaccacatccagggctccgtcgggcacgactgggcggccctcaccttttgtctgccctgcgccctctgccagatggcgcgggaactgaagatccgagagtaaggaagttccctgtcttccccgtccttttccaccagtctcgcctctggccttctctggccactcctgggagggactgcctcaccacccctgtcccgctgccagaaatacacccacaataaaaacctgaaaacc

SEQ ID NO: 6813 - DNA, 3284 bp, Homo sapiens
tgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggccaagtacctggcccagatcattgtgatgggcgtgcaggtggtgggcagggcctttgcacgggccttgcggcaggagtttgcagccagccgggccgcagctgatgcccgaggacgcgctggacaccggtctgcagccgcttccaacctctccggcctcagcctccaggaggcacagcagattctcaacgtgtccaagctgagccctgaggaggtccagaagaactatgaacacttatttaaggtgaatgataaatccgtgggtggctccttctacctgcagtcaaaggtggtccgcgcaaaggagcgcctggatgaggaactcaaaatccaggcccaggaggacagagaaaaagggcagatgccccatacgtgactgctcggctccccccgcccaccccgccgcctctaatttatagcttggtaataaatttcttttctgca

SEQ ID NO: 6814 - DNA, 3496 bp, Homo sapiens
cccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctggtgagcgcagcaggcaccactgtgaaggtctgggacgcagccaagcagcagcccctgacagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcca

SEQ ID NO: 6815 - DNA, 1622 bp, Homo sapiens
agtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagatgagggagaagaggcacagagaggtttagtgacctgcccgggtcacacagctgtctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctaca

SEQ ID NO: 6816 - DNA, 3258 bp, Homo sapiens
gtgaccgcggcattgggtcccgggtggggccgaggcagcgggagtcgcggttgctcagcgtgcacctgagacccgacgcccggggtcctcgaagacgcgtccgccgccgtgcccgtcgccatgaaccgcttcagggtgtccaagttccggcacaccgaggctcggccgccccgccgcgagtcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggcc

SEQ ID NO: 6817 - DNA, 3454 bp, Homo sapiens
ctttatctcggtgatgctgccacggctgggtggggcctggggaagcctgagcaggtggagccccaaagaattgctgagccaggtgccgggagacccttcggacccccgaaacggcaggaggactgatgaggggtgcgccttggaaacgatgtcagctctgctcttccgctttccgtgttattttcctggatcagtgacattcgagcaggaaccgccccttcatgcaggaaccacatcaaatcaagctgcagcttgatcgccttcaactccgaccgtcctggtgtactgggcattgtgcctctgcaaggccaaggagaggacaagcgacgcgtggcccacctgggctgccattcagacctagtcaccgacttggacttctcgccctttgatgacttcctcctggccacaggctcggctgacaggacggtaaaactctggcgactgccagggcctggccaggccctgccctcagcacccggggtggtgctgggccccgaggacctcccagtggaggtactgcagttccaccccacctctgacggcattctgagctggcagcccatggggacctggtgcagagcgccgtctggagccgagatggagccctggtgggcacggcgtgcaaggacaagcagctgcggatctttgaccccagaacaaagccgcgggcctctcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggactagcctgcgcccccgtcacctccacctcacctgtgctgccacttcctagtgcacacctcacggctcatcctcaagctggaagatacctctctggccccggcacatgtcacccctgcactcctgccttcccgtgggcacttccacatcctctgggcctctggcagttcccagggactgttttcacctctgctgtctctggggtcagctgctgctcatcagctgcccgctagcatgtggccaggggtgcagggtggcggggggtcagcagcatgtccctgggcaggccctgggcaccctgtctcccctggtctcactgctgacctgggctggtcccagcctggattggcctcatccaggatctttggtcaccccacgctgccccatcttgcctgctgttccagttctggtcaagggccttgggggctggccccccaccaggccttctagagcagcaccagtctcagggccctgggaccagctgccctacttcccaggtttgtagccaggagaagggggcatcacagagctgatggtccaataaggggggtgtgagccccgcagggactggcccgcacctgccttggatgttttcagcaattaaacttttttaagctggc

SEQ ID NO: 6818 - DNA, 1622 bp, Homo sapiens
gtcttgacaagagcatcttcagcgggcgagtccccggctcctccagctccttcctcctcttcctcctcctcctccacctccggcttttgggggatcactgtcctctctcggcagcagatacaggctgctcctcaagactggggctcttcacatacgctcctcaccgctctttgggcaggccgacctagcagcctcttcgggagtcctggggtggccgggggtgctggagcccccaaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtag

SEQ ID NO: 6819 - DNA, 3301 bp, Homo sapiens
gcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 6820 - DNA, 1654 bp, Homo sapiens
caccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaagactggacgtgtggacaagaatgcgcccacggtctgtggccacacagcccctgtgctagacatcgcctggtgcccgcacaatgacaacgtcattgccagtggctccgaggactgcacagtcatggtgtgggagatcccagatgggggcctgatgctgcccctgcgggagcccgtcgtcaccctggagggccacaccaagcgtgtgggcattgtggcctggcacaccacagcccagaacgtgctgctcagtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgagaaggaccgtccccacgaggggacccggcccgtgcgtgcagtgttcgtgtcggaggggaagatcctgaccacgggcttcagccgcatgagtgagcggcaggtggcgctgtgggacacaaagcacctggaggagccgctgtccctgcaggagctggacaccagcagcggtgtcctgctgcccttctttgaccctgacaccaacatcgtctacctctgtggcaagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggttctacaagctgcacgagcggaggtgtgagcccattgccatgacagtgcctcgaaagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 6821 - DNA, 1881 bp, Homo sapiens
ctccgggtccctctgtcacttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcat

SEQ ID NO: 6822 - DNA, 877 bp, Homo sapiens
acttcctgaatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccaggggtgaggaggttctgcttggcctga

SEQ ID NO: 6823 - DNA, 1902 bp, Homo sapiens
attatgaggagcaagaacgcgaaggggcctcgggtccgctaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagaaaacctcgaggaacccatggccctgcaggaactggactcgagcaacggggccctgctgcccttctacgaccccgacaccagtgtggtctacgtctgcggcaagggtgactccagcatccggtactttgagatcacagaggagcctccctacatccacttcctgaacacgttcaccagcaaggagccgcagcggggtatgggcagcatgcccaagcggggcctggaggtcagcaagtgcgagatcgcccggttctacaaactgcatgagcgcaagtgtgagcccatcgtcatgactgtgccaagaaagtcggacctcttccaggatgatctgtaccccgacacagccgggcccgaggcagccctggaggctgaggagtgggtgagcgggcgggatgccgacccgatcctcatctcactgcgggaggcctacgtgcccagcaagcagcgggacctgaagatcagccggcgcaacgtgttgtctgacagccggcccgccatggccccgggctcctcccacctaggggcccccgcctccaccaccactgctgctgatgccacccccagcggcagcctggccagagccggggaggctgggaagctggaggaggtgatgcaggagctgcgggccctgagggcgctggtcaaggagcagggcgaccgcatctgccgcctggaggagcagctgggccgcatggagaacggggatgcgtagggccacagccacacgccaccttcatctcctccgccgcccccttcccactcagcttctgccagcgggtcgcaccgggctagctggctgcccagagcctctgaggcagcgcaggggtcagttcccacccccacccgtcccaggcccaggccgaagccagcgcccagctttcctcactgttcctgtggaggatgtctacgcccaggcgagctcctcgacctctgagggaccatctccccgaccactgcccagccctctgctccctccccagaggaggcgggagggtgggctctatattttcattccaaataaaattctctttctaaaagcc

SEQ ID NO: 6824 - DNA, 1161 bp, Homo sapiens
ttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagagcgggagaaggctcatgagggggcccggcccatgcgggccatcttcctggcagatggcaaggtgttcaccacaggcttcagccgaatgagcgagcggcagctggcgctctgggacccagtgagtggccagcctgagggggcaaacttgagacttgggccccaccctgggccaggcaggcagggttcaccctggggaggcctgtggttcctagcttctctgcctggaacttgaggctctcagggcctaggactctgtcagactttcctctcctgccccctgctcgcccgactgccccaccactcccccatggcctcccactgcctctgtgtctttgcccatgttgttcatgccaacggaagggcccttctctcccttgcttgcctgtaccacccactgcctgcacagggctccccgctcctccagaaagcctcctcctccagcaagcctcctg

SEQ ID NO: 6825 - DNA, 1037 bp, Homo sapiens
aatcctgcttcctgcttcccagaggccgggatccggagccgcccgaagccggtgccgcagccccctgcgcccccggtgcccccgacatgtccttccgcaaagtggtccggcagagcaaattccggcatgtgttcgggcagccggtcaagaacgaccagtgctatgaggacattcgcgtgtcccgtgttacctgggacagcaccttctgcgccgtcaaccccaagttcctggcggtgattgtggaggccagtggagggggtgcctttctggtgctccccctaagcaagacgggccgcattgacaaggcctacccgacggtgtgtgggcacacgggacctgtcctggacatcgactggtgtcctcacaacgacgaagtcatagccagcggctcggaggactgcacggtcatggtgtggcagatcccagagaacgggctgacctccccgctgacagagccggtggtggtactggaggggcacaccaagcgagtgggcatcatcgcctggcaccccacggcccgaaacgtgctgctcagtgcaggtctgcaccgccccccgttttgtgctccccccccccacggacccctccatacatcccagcagcccctccagggcccacatgacaaatgggaaagctgaggccctcagagttggagagacccgtctgtcccagggtggtgggcagagtgggcctcagcctggtgagctaatggcctcctgccacccacccggcccgagctgacaaccctcacctgccaggctgcgacaacgtggtactcatctggaatgtgggcacagcggaggagctgtaccgcctggacagcctgcaccctgacctcatctacaatgtcagctggaaccacaatggcagcctgttttgctcagcatgcaaggacaagagcgtgcgcatcatcgacccccgtcggggcaccctggtggcagtacgtggctctggagggcaaggatggctgtggataggcccaggaccttgagcagggcgctgcactgaccagcctgtccccccgacaggagcgggag

SEQ ID NO: 6826 - DNA, 3892 bp, Homo sapiens
gcgcggcgcgggggcggggcctacgcgcggtggcgggggcggtggcggctgcccgcgcccctcccccgcacggcgctcagtgccaggctggaggcggcagcggttggaggcttcgcccggctttgcagcggggacttcggcggcggcgcctcaggcacctcggcccggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaactagcatgtgtttctgcagtttgttacacacctaggatcatattgcattcatcactttaaacatcatgtttcaggttttggtcaatacttgacaagggtgcccaggacaggaagacgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaa

SEQ ID NO: 6827 - DNA, 1633 bp, Homo sapiens
aggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctga

SEQ ID NO: 6828 - DNA, 2487 bp, Homo sapiens
gcgagaccagctctgggccctgcagatctcggttgggggtcaggcggggcggggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaaggtcccacccccacccctacagaaaaaatgggagcaagaacttgtgcttgggagctggttattggtgtggtcctagggagggcggaaagggaggcactgccatttggagacattccatttcagatttgtcaaccagcgataggccacattccagtaagaactcaatttgtctcccaaatttgcagaaacaaaacgtgatttaaaagctgagctttttatcagaaagcttttttgatgttttaagtgttatgtgacttgttgaactttttaaaaagtgctacttttaaaatcccagatactctgaattttagaaaacaaactaattctgattgtgtcgtgcccaagtacccttttttttttaatgaatagggaccaatgccacattgctttttatatttctttcttttttaatgttgccaaaaccaaaagtagctttgttttcctttgtattttgctactttgcagtatttgtgtgtgtggttttttttccttaatttgaaagggacagcactgtgtatgtttataaactaaatgaagataagatattattttgtataaacattcatctgagaacaatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgattataatctaacccaaact

SEQ ID NO: 6829 - DNA, 899 bp, Homo sapiens
gctgcgccgaaatgactgaggatgaggtcagacgtggagggtgggaatgcagaaaccgagctctcccgcctgtccccaccggcgcacgctccccagctctccgtctctcaaatgatttgaatgtgttgggggaagtggcaggctgcggtgagagctgagaagaaaggggcttcctcttggagggaggcgctggccctggcatccttttttgggagtgttcaaaggattttgaacgctggaaaaggaatcgtaggctttactgcatcacgatttagaaacacatcctatatttggccgtaatgtaggctgcccttgttttgtggtgtctaaagtgcttgctctacatgttgcaaacgtgggattcagagtgcgaagcaaattgcaagttgttcatttcccccggcatgacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacag

SEQ ID NO: 6830 - DNA, 577 bp, Homo sapiens
agcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctgaagaaattgggtgtttgtaccagaatggaattttgcttctcggttatcctgtgcttcagatgattataatctaacccaaa

SEQ ID NO: 6831 - DNA, 566 bp, Homo sapiens
actaggcggtttggtaacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctg

SEQ ID NO: 6832 - DNA, 1710 bp, Homo sapiens
ttttgcttttcaccacctcatggaagctgtcttatctaactcacgcttgagaagtattcatattgattccaaaatgaaggaccctggccacgaatcatttgccatctcctctaccaaagactcaaaatgtatggccctggtagtcagctgggaaagtctggcaataacagctgggctaaggaacgtggatgctcaattgcctgccaagggtctcttacttcagcccggctacatgcccccagcattggagagaggccactttcacacatgcgttggaaggacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttggacgatatgcattcagacatgatttacaatgtgagctggaaccggaatggcagtctgatctgcacagcttccaaagacaagaaagtgagagtcattgatcccaggaaacaagagattgttgctgagaaggagaaagcacatgaaggagcaagacccatgagagccatcttcctggccgatggcaatgtcttcaccactgggttcagccgcatgagcgagcggcagctggctctctggaatccgaaaaatatgcaggaaccaattgctcttcatgagatggacactagcaatggggtgttgctgcctttctatgaccctgacaccagcatcatttacttatgtggaaagggtgacagcagtattcgctattttgagatcacggatgaatccccgtacgtccactacctcaacacattcagcagcaaggagcctcagagagggatgggttacatgcccaagaggggacttgatgttaacaaatgtgagattgccagattcttcaaacttcatgagagaaagtgtgaacctattattatgactgttcccaggaagtctgaccttttccaagatgacctgtatcctgacacagcggggccagaggccgcgctggaggcagaagagtggttcgaaggcaagaatgcagacccaatcctcatctccttgaagcacgggtacattccaggcaaaaacagggatctcaaggtggtcaagaagaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagcgtatttccaagttagaacagcagatggcaaagatagcagcctga

SEQ ID NO: 6833 - DNA, 547 bp, Homo sapiens
aattctaacataattctcactcttcctttgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacaggggaagcccttataaacttgga

SEQ ID NO: 6834 - DNA, 567 bp, Homo sapiens
gtcggatcgggggcccagggtgtccgagtgaactgggtgattcagaggtgtgtttccctaatagcggggcagctggcgagggacgcagtaaaaaggagcgaggtgcagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggtggga

SEQ ID NO: 6835 - DNA, 547 bp, Homo sapiens
aggctttcgaggtccggaacgctcctggccgggtgcggagccgcgggccgagacacgatgaggcgagtggtacgacagagcaagtttcggcatgtatttgggcaagcggtgaaaaatgaccagtgctatgatgacatccgggtttctcgtgtgacctgggatagttccttttgtgctgtcaatcccagatttgttgccataatcatagaggcaagtgggggaggagcgttccttgtcctccctctgcacaagactggtcgaattgacaaatcttaccctacagtatgtggccacacaggaccagtgctggacatagactggtgcccacataacgatcaggtcattgccagcggttcagaggactgcacggtcatggtatggcagatcccagaaaatggactcaccctttccctgactgaacctgtggtgattttggaaggccactcaaagagagtcggcatcgtggcttggcatccaacggcccgcaatgtgcttcttagtgcaggctgtgataatgccattatcatctggaatgtgggaacagggg

SEQ ID NO: 6836 - DNA, 5635 bp, Homo sapiens
cactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 6837 - DNA, 5459 bp, Homo sapiens
cgggagtcggcgggcggcgaggagcgcggagccggagctggacgccgccgccgccaccgccacctgcgcggcagtcatcaagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccagacagggaagttggacccccactacccaaaagtctgcgggcacagaggcaacgttttggatgtcaagtggaacccttttgatgattttgagatcgcctcctgttctgaagatgccacaattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggaggccagctacaaagggcaccgggccagcaaagtgctgtttctggggaacctgaagaagctgatgtccacaggcacatcccgatggaacaaccggcaggtggccttgtgggaccaggataacctctctgtgcctctgatggaggaggacctggacggctcctcgggcgtgctgtttcccttctatgacgcggacaccagcatgctctacgtggtggggaagggagatggcaacatccgctactacgaggtgagcgccgacaagcctcacctgagctacctgactgagtaccgctcctataacccacagaaggggatcggtgtcatgccaaagagaggactcgacgtgtcctcctgcgagatcttccgcttctacaagctgatcacaaccaaaagcctcatcgagcccatctccatgattgtgccccggcggtcagaatcctaccaagaggacatataccctccaacagcaggggcccagccctccctgacggcccaggagtggctcagcgggatgaatcgagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatggtcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccagctgtggtttattctgcttgtatgtctgcacaggccggatgctcgtgttccttgtcttattctccatttactcagtcactggggctcactcccgtctgatgcactagccaagattgccttagtgtgctccagaaaagaaggccaaatcccaggcattgtcagggcagcagagctctacaggataggcttacctttcccacctgtgtggctagcacttcacagtttacaaattcctcccacctccactcagtgacacatgctgttctaacacaggtcaggcaggcattacagtccccatgttcagaatcaaagacctagcctcagagaagtgaagaaacatcatgccaaggtcattgactgccaagcggtagaggtggggttgcatccagagagcttcccggtatgcctctgcacaatgccattccttggccagctccctccaccccaagggacccagactgcacacttaacaaacaggacacaggtgtctttgaacaaacttttttgtattattatttttacatctagaataaattatttaaattatttcacagcaagggagagggataggtaatttttatcagatatttttttaaaccatctgttttttaaattacatttttgtttatgttcttgagctgatgtagtggaacttgcctagcacattcaggtcccagccagttggcagagcatgctctcatctccttattccataccctgggcgtcccctttctgttgactcaggaactttctgagaatgaggacagcactaggagatgagctttggcaggtatccaccttaacgctacaataattgtgcttcctgaaacaaaacttgagattgtatcatagaaggaaacaggaagtcagaaatcaaatctatgcttttaattgaaaccgtgcctgaaacagtttgaatgattgttttaatgttgtttctgaaattccttgtacctttgtgaaaaataatgataataaataaaagtgaaaataaatagatgtggaatatgcaatggaaataatgtaacaaaataataaacatctggccattttactacaa

SEQ ID NO: 6838 - DNA, 3569 bp, Homo sapiens
cgggccctctccctctctccctttcttcctgcctcgccttcctgcggcgaaggaggctcatctattataaatgcacattcggggctgacatcagcgacgagcggcgggcgagcgccgacgagcggtccctgcgcgctgcccgcccggagcgcagcccccaggctcggccgagccgccggcggggcgcggggagcgagccgggagctgccggacccccttccgccgccgccccgggccgccgccgccgcccccgcacgccgcgcccgcgcccccgctccgccgcggagtttctgcatgactgtcacaaagatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatcaaa

SEQ ID NO: 6839 - DNA, 3332 bp, Homo sapiens
attcaaaccgcctgctgggtgccgtgggccattgtgcaagtcttccaggccgcggtcgaatgattctgacaagcgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 6840 - DNA, 3611 bp, Homo sapiens
acagattctgttgacctttagtaatgagggaggcagggctagagggtgactagcagccaggcctcccaggctcccaggcctctcagatgcctggaatttcggagctagaaggtagtcagattcccgttatcttgactgctgcagcggggtctctgggatggtgatgtgagtgcctcctgcacccgtggcccccatgtggcataactccttgggcgctattcatccacacggcccatctgtgcagggtacagccttcatggtcttagctggcagccctgacaacttggatgtgcaaagaagatacaagtttgtttcctctgaagcttgtctggtgtcatccaggagccccacctgatgtcctggcgtccgcaataccgtagctccaagttccggaatgtctacgggaaggtggccaaccgggagcactgcttcgatgggatccccatcaccaagaatgtgcacgacaaccacttctgtgccgtcaacacccgcttcctggccatcgtcaccgagagcgcagggggcggctccttcctcgtcatccccctggagcagacaggcaggattgaacccaactaccccaaggtctgcggccaccagggcaatgtgctggatatcaaatggaaccccttcatcgacaacatcattgcctcgtgctcggaggacacgtcggtgcggatctgggagatccccgagggcgggctgaagcggaacatgacggaggcgctcctggagctgcacgggcacagccggcgtgtggggctggtcgagtggcaccccaccaccaacaacatcctgttcagcgctggctacgactacaaggtcctcatctggaacctggatgtgggtgagccggtgaagatgattgactgccacacggatgtgatcctctgcatgtccttcaacacggacggcagcctgctcaccaccacgtgcaaggacaagaagctgcgtgtgattgagccccgctctggccgtgttctgcaggaggccaactgcaaaaaccacagagtgaaccgggtggtgttcctggggaacatgaagcggctcctcacgacaggggtctccaggtggaacacaagacagattgccctctgggaccaggaggacctctccatgcccctgatcgaagaggaaattgatgggctctctggcctcctgttccccttctatgatgctgacacccacatgctctacctggctggaaagggtgatggaaacatccggtactacgagatcagcactgagaagccctacctgagttacctcatggagttccgctccccagccccgcagaaaggcctaggggtcatgcccaagcacgggctggatgtgtcagcctgcgaggtgttccgcttctacaagctggtgactctcaagggcctgatcgagcccatctccatgatcgtgccccggaggtcagattcctaccaggaagacatttacccaatgacaccaggcacggagccagcactgaccccggatgaatggctgggaggcatcaaccgagatcccgtgctgatgtctttgaaagaaggctataagaagtcctcaaaaatggtatttaaggctcccatcaaagaaaagaagagtgttgtggtcaacggaatagatttattagaaaatgtcccacccaggacagagaatgagctccttcgaatgttcttccggcagcaggatgagattcgacggttgaaagaggagctggcccagaaggacatccgcattcggcagctccagctggaactgaaaaacttgcgcaacagccccaagaactgttagctccccagctgggctgttttctaagccgatctctccgtcgtttctactcatcccttaacttctcccttaccagtgaccccagagacagagccaggacaggagtgggggccagcctgaggacccccgcctaccacctcgagaactggaagccaacctctaacctcctgacctcatgctaataaaagtccccagcttctggagaccccctgccggcagcccctttccctgccaccccaggagccaggcttcccctcagctgggtgaagactacagactccctggggttggcaggggctccatctcagtggaccaggaagcaagaggggaagcgggatcccagctagacttagaacttggacttttcccctgtgaagggggctgccaggacatctcagcactcccgcctggagctctcagcatcactgaaggtaccacagtgtaagtgctggactgcaggctgcagtgatccctctttcgtcccaccccctcttccctcagcagccccggaagcctgcctcacccgacgaggacagcgagcggcccggctcctttctgtctcttcccttcccaccctcttgtcttcagggaattcagaggattgctctccaaggccataatgaccccttgccttccccatgattctctacaaagctcttgcacacccttttcccattcaatttgtgagccaggcagggtagggattagtgtccccctttgacaaatgacagaactgagggttgcaatggggaaatgacttataaagtcacccagcaggtcaacaatgggcccacgaccaagaccctgggtgttcagaccccaaggccagggcctttcccgctgcatcaagatgccaatccctttgtgggcttcaccagtgcccaagtctctatggagaatgagaactggaagccactgctaccgtctacccagcaccagtagtgccgatgtgccacactgcccagttgaggcccctcacgctctgtgcccctagatccttcaggtccccaccctcagctgtcaccaccaccctccccaggggactccatctgagatgaggcctcgtcctcctggaagctgaggctgagaagggtggagcttggccctggggaaggcagaccagggtctgatggcttctagggatgctctgcgtgtgtctcagcaccgctatctcagccactttcagccttatgcacgtagaatgaccacagccactcgcatccgtatagcactttaaagtttctgcagtcctttgacacataggatctcatggagcctcacgtctactcccttctgcagatgaggaaaccgagagaagtggcccaaggtcacgcaactctgagatgccacatttcatttgatcttgtacacattttcttttattccttcttttttcctcctttcatttcccactacgcacaaagagtttataaacactgttctcagaagagtcacagtttggggtgagatctggaaatcaagaaatgggtgtccactcttttctttcattagctaggatctactagatgcattatactccatacctgcttttcccatggccgccctacggaaaatcccatccacagaggccagggctacccaagcccctccaggtgagctgggcctttcctttatgaacctccatcctcccagccagctacagtagggcctcctcaccccgtaccccacagctagacagtgtcagcactcatctcctcctcccacatttctggagcttttttttttccttccccattgacctttgtggtcttctgtgattatttatgctgcctcccaaggatagaattgaaataaaatgttttcaacttatc

SEQ ID NO: 6841 - DNA, 5970 bp, Homo sapiens
ggacagcagcgggttaagtgccgcccgcgcggagacggctgagtccggagccgcggctccgagctcgcattcggatccgctagagcaggaagatggcgacggacggcgcgagctgcgagcccgacttgtcccgggccccggaggacgcggcgggggccgcggcggaggcggcgaaaaaagagtttgatgtggatactctcagtaaatccgagctgcggatgctcctcagcgtgatggaaggggagctggaggccagagaccttgtcatcgaggccctgcgggctcgcaggaaggaggtatttatccaggaacggtatgggagatttaatctaaatgacccgttcctggcactccagagagactatgaagcaggtgctggtgacaaagagaagaagccagtttgtaccaaccccctctccatccttgaagcagtcatggcccactgcaagaaaatgcaagaaaggatgtccgcacagctggctgctgctgagagcagacaaaagaagctggaaatggagaagcttcagctacaagcccttgagcaagagcacaagaagctggctgcccgccttgaggaagagcgtggcaagaacaagcaggtggtcctgatgctggtcaaagagtgcaagcagctctcaggcaaagtcatagaggaggcccagaagctcgaagacgtaatggccaaactggaagaggaaaagaaaaagacgaatgaattagaagaggaactctccgctgagaaacgaagaagcacagaaatggaagctcagatggaaaaacaactctctgagtttgacactgagcgggaacagcttcgtgccaagctgaaccgggaagaagcacacaccactgacctcaaagaggagatagacaagatgaggaaaatgattgagcaactgaaaaggggaagtgacagcaaaccaagcctctctcttccacggaagacaaaagataggcgtttggtttccatatctgtgggaacagaaggaactgtgacaaggtctgttgcatgccagacagacctagtgacagaaaatgctgaccacatgaaaaagttgcctttaaccatgcctgtaaaaccttccacagggagtcccctagtttctgcaaatgcaaaagggagcgtgtgcaccagtgccaccatggccagaccaggtattgacaggcaggcttcctatggtgacttgattggcgcttctgtacccgctttcccacctccaagtgcaaacaaaattgaggaaaatggaccaagcactggctcaacaccagatccaaccagtagcacacccccacttcccagtaacgctgcccctcccaccgctcaaacaccaggcatagctcctcagaactcgcaagctccacctatgcacagtttacattcaccatgtgccaacacctctttgcatccaggtctaaacccacgaatccaagcagctagatttagatttcagggcaatgctaacgacccagaccaaaatggaaatactacccaaagtcctccgtcaagagatgtctcgcctacaagtcgtgacaacctagtggccaaacaactagctcggaatactgtgacccaagcactgtcaagatttacaagccctcaagcaggtgctccctcaaggcctggagtgcccccaacaggggatgttggcacccaccctccagttggtcggaccagtttaaagactcatggtgtagcacgagttgacagaggaaatcctcctcctatccctccaaaaaagccagggctctcccaaactccttctccaccacacccccaactcaaggttattatagacagcagcagggcctcgaacacaggggccaaagttgataacaaaactgtggcttcgactccttccagtttgccacaagggaacagggtgatcaatgaggagaaccttcctaagtcatcctcccctcagctgccaccaaaaccatccatagatttaactgtggcacctgcaggctgtgccgtttcagccctggccacgtctcaggtgggtgcctggcctgctgcaacccccggactgaaccaacctgcatgttcagacagttcccttgtcattcctaccaccattgccttttgctcttccataaaccccgttagtgcctcatcctgtagaccaggtgcctcagacagcctcctggtaacagcatcaggctggtcaccctccctaacccctttgctaatgagtggtggtcctgcccccctggctggcaggcccacccttcttcagcaagctgctgcccagggaaatgtcactttattatcaatgctgcttaatgaagaaggactggacattaattactcctgtgaagatggccattctgccttgtattctgctgctaagaatggacatacagactgtgtgagattgctgctgagtgcagaagcccaagtcaatgctgctgataaaaatggcttcacacccttgtgtgctgcagctgctcagggacatttcgagtgtgtagaattattaatttcatatgatgctaacattaatcatgctgctgatggaggacagacacctctatacctggcctgtaaaaatggaaataaagaatgtattaaactcttgttggaagctggaaccaatcgaagtgtaaaaaccacagatggctggacaccagttcacgcagctgtggacactggtaatgtggacagcctcaagcttcttatgtaccatagaataccagctcatggaaattctttcaatgaggaggagtccgagtcaagtgtctttgacttggatggaggagaagagagtcctgaaggcatatccaagcctgttgttcctgcagacctcattaaccacgccaacagagaaggctggactgctgcccacattgctgcttccaaaggttttaagaactgcctagaaatcttgtgtaggcacggagggcttgagccagaaaggagagacaagtgcaatcggactgtgcatgatgttgccactgatgactgcaagcatttgctggagaatctgaatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggaaatgtgccgtggtcagtgggtcagagcttcgcgcagtccccgtgggactttatgaggaagaataaggcagagcacatcactgtgcttttgtcaggtcctcaagaaggctgtctcagtagtgtgacttatgcctccatgatccctctccagatgatgcagaactacctcaggctggttgagcaatatcataatgtcattttccacggcccagaaggaagcttgcaagactacatagtacatcagcttgcactctgcctgaagcacagacaaatggctgcaggattctcctgtgaaatagtgagagctgaagtagatgctggtttttccaaggaacagctactagacctgttcattagtagcgcttgtctgatcccagtgaaacaatctcccagtaagaagaaaatcatcatcattttagaaaatttagaaaaatcttcactgtcggagttattgagggactttttggcacctcttgaaaatcgcagcactgaaagcccctgcactttccaaaaaggaaatggactgtccgaatgttattactttcatgagaactgctttctgatgggaaccatcgccaaggcctgtctccagggctccgacttgctggtgcagcagcatttccgctgggtgcagctgcggtgggatggcgagcccatgcaaggactgctgcagaggttcttacgaaggaaagttgtgaataagttcaaaggtcaggcgccctccccctgcgatcctgtgtgcaagattgtcgactgggctctgtccgtctggcgtcagcttaactcctgcctggcccgcttgggcacacctgaagcacttcttggaccaaaatatttcctgtcttgtcctgtagttcctgggcatgcccaagtgacagtgaagtggatgtctaagctgtggaatggcgtcatcgcacccagagttcaagaagcaatattgtcaagagcctctgtgaaaagacaacctggctttgggcagacaactgctaaaagacaccctagccaaggacagcaggctgtggtcaaagctgctctcagcatcttgctaaataaagctgtactgcatggctgtcccctccccagagcagagctagaccagcatacagctgatttcaaaggaggaagtttccctttatccatagtttccagttataacacttgtaacaagaagaaaggagagagtggtgcctggagaaaggtgaacaccagtcctcgcaggaagtctggccgcttctctttacccacctggaataagccagacctaagcactgaaggtatgaaaaataagactatatcacagctgaattgtaacaggaatgcttctctgtcaaaacaaaagtctttagagaatgatctatcactgacgttgaatttggatcagagactctctctgggttcagatgacgaagcagatcttgtcaaggaacttcagagcatgtgctccagcaagtctgagtctgatatcagcaagattgctgattccagggatgatttaaggatgtttgatagttctggaaacaaccctgtactttcagcaactattaataatctgagaatgccagtgtcacaaaaggaggtcagtcctctcagcagccatcaaactactgaatgcagcaacagtaaatcaaagactgagttgggtgtttcaagagttaaatcttttcttcctgttcctagaagtaaagtcacccagtgttcccagaacaccaaaagaagcagcagcagcagtaatacaaggcaaatagaaatcaacaacaactcaaaagaagtgaattggaacttacacaaaaatgaacacctagaaaaacctaacaaataggcctgcctacaatattctcattattaacttcctctatttcacacagaaaccaaggacaacaagatacaaatacctttaaattgataaaatgttttcactgtaatataaattatgagtgcgggaccactattcaatttttttttgtaaagaatgtatttataaccaacattttgttgcttttttttttaattctgtaggattgaacttcaataccaggaagttatgccaacttttcaagtagttttataatagaaaaattgtaatagttttaatcaagatgttcaggggtattaaaacagaactgtgtactgtatatctgtatatatgtatatatgtatgtatatttaaggaagtccagaaatcatactgcatacatgctacaaaaaagtagcaaaaaagtacaaagttggcttagataacttgtaccgttttaaatggagatcataattttatgttcacttgatggggaatgactagaatggggcaataacaaatcatttctaaacagttattttccattaaaagccatattaagtattttgcttgttaaattctagttttatgttttaaatctcttagtggttacattgccatttggtagcatcatgtatatatttatgcttataagtttgcattatgactcctgtaaaatatgaaattataatgcaataaaagtgttatctttcttacaaaagttttgtacctaagtggatatagataactgcataaatgaataaattcagaattaactccttcaatatttctagtagcacaactgataatattgatattttctacaaatgttacttctaaaattacagacaaaattacttacacaattcagttaagatgctttgacactgaataaaatattgatttcatgaaa

SEQ ID NO: 6842 - DNA, 1262 bp, Homo sapiens
ataggaacagccgcggcggcccggctcgcgcgctgcttgcctgcctcggtctccgccgctccaggggcgggtggggtgggctgagccggagcccgggccgccgccgccgccgccggggagaggccgaacgcgcagccggcgcgggtccctgagagagcgcggccgccgggcggtcggtccccgtccgggtcgaagccaggggcgcgcggcgatgtgagccatgagcgcgacgtggacgctgtcgccggagcccctgccgccgtcgacggggcccccggtgggcgcgggcctggacgcggagcagcgcacggtgttcgccttcgtgctctgcctgctcgtggtgctggtgctgttgatggtgcgctgcgtgcgcatcctgctcgacccctacagccgcatgcccgcctcgtcctggaccgaccacaaggaggcgctcgagcgcgggcagttcgactacgcgttggtgtgaggggcgcggcgccccctagccggccctgcgccggggtctcagagggccggcccggcggggggcgccgcggggccaggactgcgctcaggatcccgccccggagcccccagcccgggggagagggggagggagttgggagaagcccagcccctccccctcgagacccctcccatgtcccttcctggcctggccggagccccacctcgtgcctttatccgccctgtcccttcctctctgcgcatctcacccgcccggctggcccccacccccgactctgaatcccgggcgggaggaggacccccgcaccgccccctccccagcgtgtaagtggctctgctattgtgcgtccctggaagtggggacccccttgtccctcctccctcccctgttgtctggccgtcgtcaaccccaccttgactgagtgttgagcccgtccttgggctctggtccctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgctt

SEQ ID NO: 6843 - DNA, 1980 bp, Homo sapiens
actttgatttgcaaaatggaaaattccctgaatgcccacagaaaagtataatgtagcatttagcaggtcaacaaaatgcactcccttattctttgtctccgcctcattctccaacactttagtgcactaagttgtagtgactgaaatcattcttggtgaataatgctgggccacgctgaaaatttgtggctgagagctggaccctcgtcatcgccacgtactctgtcaatgagacagggtaacccatggttactgagctccgatcagttaaggggcagagagcctccgctccccactgctctataaaagagacccagcaaagggaccctaccagcttctagctctcagtctgcgcgagggtgtaggaaggaaagcccaggacctccggagcagagcacagcagctgcagaggcaaggccagcatgtcgcccaacttcaaacttcagtgtcacttcattctcatcttcctgacggctctaagaggggaaagccggtacctagagctgagggaagcggcggactacgatcctttcctgctcttcagcgccaacctgaagcgggagctggctggggagcagccgtaccgccgcgctctgcggtgcctggacatgctgagcctccagggccagttcaccttcaccgccgaccggccgcagctgcactgcgcagccttcttcatcagcgagcccgaggagttcattaccatccactacgaccaggtctccatcgactgtcagggcggcgacttcctgaaggtatttgatggttggattctcaagggggagaagttccccagttcccaggatcatcctctcccctcagctgagcggtacatagatttctgtgagagtggtcttagcaggaggagcatcagatcttcccagaatgtggccatgatcttcttccgagtccatgaaccaggaaatggattcacattaaccataaagacagaccccaacctctttccttgcaatgtcatttctcagactccaaatggaaagtttaccctggtagttccacaccagcatcgaaactgcagcttctccataatttatcctgtggtgatcaaaatatctgatcttaccctgggacacgtaaatggtcttcagttaaagaaatcctcagcaggttgcgagggaataggagactttgtggagctgctgggaggaactggattggacccttccaagatgacgcctttagctgatctctgctacccctttcatggcccggcccagatgaaagttggctgtgacaacactgtggtgcgcatggtctccagtggaaaacacgtaaatcgtgtgacttttgagtatcgtcagctggagccgtacgagctggaaaacccaaatggaaacagtatcggggaattctgtttgtctggtctttgaataaccaacccagtgatttacatgctgatagctaagtgagtttttaatggccattgtgtatgattttgatgcacaactagttaaaagcctttcataccagtcagtattcccagccttgagcgcacgcgcgcacacacacacacacatacacacacgcattaatttttgtactttgcttcttttatgtttgtaatctgtaaatgaacacatggcagaaaataacccctgattggtaggatcatagttctaaatggaaatgtttgtaattctttgatgtgctacaaacctgaaactggtaagacaagcacaaagcaacgtgcaatacaaaaatcgtatctcaagggaaaatactcaaagaaagaaaagtggcagcacttatattagttttataacaggataaagtcttgtgtatagcaaagtagttgcatctgtttattttctatttattattgttacaataggtaatagttatagcaattatttattgatttgtaacaacttgtttttaaccaaactttgtagcatggaaaaaattttccatccacaaatacaaacatgaataaatacattcagaatgttggcaccatga

SEQ ID NO: 6844 - DNA, 1618 bp, Homo sapiens
ctttcagataccttctcgaaacaaaagattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggca

SEQ ID NO: 6845 - DNA, 2576 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 6846 - DNA, 1577 bp, Homo sapiens
agattttcctacctgcttatacttggtaaccgagggaatttctaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggaacgaggggtccctgagggaaaggactggggctccttcatctctatgatcctagtgcagtgtctgaaggcatcaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcct

SEQ ID NO: 6847 - DNA, 2534 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 6848 - DNA, 2456 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcagacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 6849 - DNA, 2663 bp, Homo sapiens
ggcgaggccggcaagaggcggccgcgggccgggctgcgtcgggaaacggcggccagacttccccgggaaggggcgagcgagagccgggccgggccgggccgggccgcggggccgggaagcgccgagccgggcatctcctcaccaggcagcgaccgaggagcccggccgcccaccccgtgccgcccgagcccgcagccgcccgccggtccctctgggatgtccgtaggacccgggcattcaggacggtagccgagcgagcccgaggatgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggccaggctgcacccattggggtgaccaggcagatggagccctggaggtgggggctccatggagtggtgccccatttcaggttcgaaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaataatatttatcttttcaaccagc

SEQ ID NO: 6850 - DNA, 231 bp, Homo sapiens
gtgtacaccgactacatctacttcaactccttcctggaatccttccagggcttctttgtgtctgtgttctactgtttcctcaatagtgaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 6851 - DNA, 1206 bp, Homo sapiens
atgggagggcacccgcagctccgtctcgtcaaggcccttctccttctggggctgaaccccgtctctgcctccctccaggaccagcactgcgagagcctgtccctggccagcaacatctcaggactgcagtgcaacgcatccgtggacctcattggcacctgctggccccgcagccctgcggggcagctagtggttcggccctgccctgcctttttctatggtgtccgctacaataccacaaacaatggctaccgggagtgcctggccaatggcagctgggccgcccgcgtgaattactccgagtgccaggagatcctcaatgaggagaaaaaaagcaaggtgcactaccatgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaaccatgagccccgaggtccaccagagcaacgtgggctggtgcaggttggtgacagccgcctacaactacttccatgtgaccaacttcttctggatgttcggcgagggctgctacctgcacacagccatcgtgctcacctactccactgaccggctgcgcaaatggatgttcatctgcattggctggggtgtgcccttccccatcattgtggcctgggccattgggaagctgtactacgacaatgagaagtgctggtttggcaaaaggcctggggtgtacaccgactacatctaccagggccccatgatcctggtcctgctgatcaatttcatcttccttttcaacatcgtccgcatcctcatgaccaagctccgggcatccaccacgtctgagaccattcagtacaggaaggctgtgaaagccactctggtgctgctgcccctcctgggcatcacctacatgctgttcttcgtcaatcccggggaggatgaggtctcccgggtcgtcttcatctacttcaactccttcctggaatccttccaggtccgttctgccatccggaagaggtggcaccggtggcaggacaagcactcgatccgtgcccgagtggcccgtgccatgtccatccccacctccccaacccgtgtcagctttcacagcatcaagcagtccacagcagtctga

SEQ ID NO: 6852 - DNA, 1407 bp, Homo sapiens
atgggaagagagccttggcctgaagacagggacctgggctttcctcagctcttctgccaaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagg

SEQ ID NO: 6853 - DNA, 1600 bp, Homo sapiens
ggggctggccagggtgtgaccaccgtgctgggcagcaggctccagtccctaacccccagccactactggcatgaggggtccctcagggcccccaggcctcctctacgtcccacacctcctcctctgcctgctctgcctcctcccaccgccgctccaatacgcagccgggcagagccagatgcccaaagaccagcccctgtgggcacttctggagcagtactgccacaccatcatgaccctcaccaacctctcaggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagg

SEQ ID NO: 6854 - DNA, 2530 bp, Homo sapiens
agcattccgtcaccccaggcccacgctctccagcccaccgccctcctctggacgccgcgagtggaagagagctgcgaactgagaagccgtactttgggcagggtggagggcccgggggctggagactgagcccctccgagaggagccgcccggccccgccccccggcgcagccattggccgcggcggagcggctgtacccgcagctccgtgcactcggcggctcctctccgggaaggtccccacttgacagctctgggcgaccggaggtggcgcccaaaggctgcccgggagatcggggctgggctggcgggggccaggaccccgcgccctctcggccgctcactctcgcgtccactccctcgcagtcacgccgggcgcgcactcccactccctctccgcacgcggctgcgggacgcgatggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggcctccacactcagtggtgcccctgcagttgggtggggtacgccagcaaaggatcagtttggctgccttatcccaggggctgtcacctagagaggctcacttgtaccccacccttgttcctgtgtcccctccccagccatcctcccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaaccaaccatgtcttcagtgattgaaactcataccccattgccctttgccctccagtctccccttcagaaacatctctgctctctgtgaaataaaccatgcctcttgg

SEQ ID NO: 6855 - DNA, 1420 bp, Homo sapiens
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccgctgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggggctggagccagtttagaaggtcaactatgcagccccgaaataacatgccagcaccccacatgtgcactcagagctgggtgagcaaggaagcccaggccgcagggcctcatggaagagagaagccagagcagaggtggtgacagaaggaagcttccagaaagagatgtgtgccaagcaatcaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtga

SEQ ID NO: 6856 - DNA, 931 bp, Homo sapiens
gcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctac

SEQ ID NO: 6857 - DNA, 1130 bp, Homo sapiens
atagtagaagaatgtctctgaaattactggatgagtttcagtcatactttcacatgggcacaatttcacattcaagctccttatcctaggctaattttatattatgttaaatcacttgtttttgttctcacggcttcctgcctgctataggcataattacgaggaagcagaacttctccagaagcaagcgcacatgcgttccaaaataagagcaaattcgctctaaacacaggaaaagacctgaagctttaattaaggggttacatccaaccccagagcgcttttgtgggcactgattgctccagcttctgcgtcactgcgcgagggaagagggaagaggatccaggcgttagacatgtatagacacaaaaacagctggagattgggcttaaaatacccaccaagctccaaagaagagacccaagtccccaaaacattgatttcagggctgccaggaaggaagagcagcagcagggtgggagagaagctccagtcagcccacaagatgccattgtcccccggcctcctgctgctgctgctctccggggccacggccaccgctgccctgcccctggagggtggccccaccggccgagacagcgagcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataaaacctcacccatgaatgctcacgcaagtgtaatgacagacctgaataaaatgtattaagcagcagtgatctttcctctcctccttcccaagtcatttgaaaagtgtttgttatttaaattccaataatgcccaatactgacgtgtcttgagtaatttggaacccaaagtgaagatctttgataaagatttttttgtggttcgactggactgtgctgagtgcgggcactgggcttttcttctgatgttcattatggtgctgggaagctctgtctttgatttaaaataaaatagctaaaggctacacaa

SEQ ID NO: 6858 - DNA, 2873 bp, Homo sapiens
ggaagatggcggcgcccagcgtcccgtgaggagagaggacacagggatcccggggagcggccccagactcgtaaattatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcagagtggcacttggtggccagaaagtgtgagcctcatgatctgctgtctgtagttctgtgagctcaggtccctcaaaggcctcggagcacccccttcctggtgactgagccagggcctgcatttttggttttccccaccccacacattctcaaccatagtccttctaacaataccaatagctaggacccggctgctgtgcactgggactggggattccacatgtttgccttgggagtctcaagctggactgccagcccctgtcctcccttcacccccattgcgtatgagcatttcagaactccaaggagtcacaggcatctttatagttcacgttaacatatagacactgttggaagcagttccttctaaaagggtagccctggacttaataccagccggatacctctggcccccaccccattactgtacctctggagtcactactgtgggtcgccactcctctgctacacagcacggctttttcaaggctgtattgagaagggaagttaggaagaagggtgtgctgggctaaccagcccacagagctcacattcctgtcccttgggtgaaaaatacatgtccatcctgatatctcctgaattcagaaattagcctccacatgtgcaatggctttaagagccagaagcagggttctgggaattttgcaagttatcctgtggccaggtgtggtctcggttaccaaatacggttacctgcagctttttagtcctttgtgctcccacgggtctgcagagtcccatctgcccaaaggtcttgaagcttgacaggatgttttcattactcagtctcccagggcactgctggtccgtagggattcattggtcggggtgggagagttaaacaacatttaaacagagttctctcaaaaatgtctaaagggattgtaggtagataacatccaatcactgtttgcacttatctgaaatcttccctcttggctgcccccaggtatttactgtggagaacattgcataggaatgtctggaaaaagcctctacaacttgttacagccttcacatttgtacaattcattgattctcttttccttccacaataaaatggtatacaagaa

SEQ ID NO: 6859 - DNA, 646 bp, Homo sapiens
caggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacaggtactttgtttttctgatatacttacttatttgaaactctatctttagtgaaacaaaaagctaattttatttaccacctgaaaagaataatttggaactgcaggtcctgtcttagtatttttcctctcttcaatttaactgggatttgaaattaaattttctgaattctatttacacagaattgtaaatagtattgcattgtaagtattgtattaaaaatagtcaccctttcctttgcaattaaagttgaatgtttatcctgctta

SEQ ID NO: 6860 - DNA, 1509 bp, Homo sapiens
ttatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgtatgtcacacagctgaacagaagccacaaccagcaagtaagacccaagccagaaccagtagcatctcctttccttgaaaaaacatcttcaggtcaagccaaagcagaaatatatgagatgagacctctctcaccgcccagcctatctttgtccagaaagccaaatgaaaaggaattgatagaactagagccagactcagtaattgaagactcaatagatgtagggaaagagacaaaagaggaaaagcggtggaaagagatgaagctgcaagtgtatgatttgccaggaattttggctcgactatccaaaatcaaactcacagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggt

SEQ ID NO: 6861 - DNA, 1384 bp, Homo sapiens
ttatggccgcatctccgcacactctctcctcacgcctcctgacaggttgcgtaggaggctctgtctggtatcttgaaagaagaactatacaggactcccctcacaagttcttacatcttctcaggaatgtcaataagcagtggattacatttcagcactttagcttcctcaaacgcatgctctggttgtaagtaccactgcagctggatttgcattggctccgggcccttttgactggccctgtttcctgcttacttctgttgggacaggccttgcatcctgtgctgccaactccatcaatcagttttttgaggtgccatttgactcaaacatgaataggacaaagaacagaccgctggttcgtggacagatcagcccattgctagctgtgtcctttgccacttgttgtgctgttccgggagttgccattctgaccttgggggtgaatccactcacaggagccctggggctcttcaacattttcctgtatacctgctgctacacaccactgaaaaggatcagcattgccaacacatgggtcggagctgtggttggggccatcccgcctgtcatgggctggacagcggccacgggcagcctcgatgctggcgcatttctcctgggaggaatcctctactcctggcagtttcctcatttcaacgccctgagctggggcctccgtgaagactactcccggggcggctactgcatgatgtcggtcacccacccgggcctgtgccggcgcgtggcgctgcgccactgcctggccctgctcgtgctgtccgcagcagcccctgtgctggacatcaccacatggaccttccccatcatggcccttcccatcaatgcgtacatctcctacctcggcttccgcttctacgtggacgcagaccgcaggagctcgcggagactgttcttctgcagcctgtggcacctgccgctgctgctgctgctcatgctcacctgcaagcggccgagcggaggcggggacgcagggccccctcccagctgagagcactgggacgcccaccgcccctttccctccgctgccaggcgagcatgttgtggtaattctggaacacaagaagagaaattgctgggtttagaacaagattataaacgaattcggtgctcagtgatcacttgacagttttttttttttttaaatattacccaaaatgctccccaaataagaaatgcatcagctcagtcagtgaatacaaaaaaggaattatttttccctttgagggtctttatacatctctcctccaaccccaccctctattctgtttcttcctcctcacatgggggtacacatacacagcttcctcttttggttccatccttaccaccacaccacacgcacactccacatgcccagcag

SEQ ID NO: 6862 - DNA, 2414 bp, Homo sapiens
ctcgcgagatttgacctctcgtccctgagaggcgggtgggtgttagttcagagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacagtgcttctgttttgaagaacaaaggcttaatccccaagaggaagtagatatgccagtgtttttctacattgatcctgaatttgctgaagatccaagaatgattaaagttgatcttatcactctttcttacactttttttgaagcaaaggaagggcacaagttgccagttccaggatataattgaagtcagcaactaagtcttccttcaaagttgtgatttttgggaaaatcatatatcctatcttctcaaaggagaaatattgtacaataatatgaaggcttatattttaaataattattttttctcaactaatttttttcacttaaacttgagagaacaagttcagcttttatcataagaaactcatatgcctagctagaatatatgactgactattcaataccatactgaagagtttgatactattaaaataagccgctttgttttttaaatatgcaggcatgggttcagcttaattccataattcccttccagattattaactcttcatacttacagcaatgaatctgacaatgtttttcaaaaatgtatgctcagggttatttgtttcaagtcataggccagaacttctaaccatgtttattgtgtctaaaagagttggttgctattttccttcattatgaatagtcagtattttaaaagctcaaagtagaagaggagtcactaagccctaacagcttgtccaaagatttaaattcttatttcaaatttgatttgtcctttaaggtttagggctattttatattcagagttctgaataattactttgaaactgtagtatcataaaattgaaataaaatacatctactaggctgttagccaaagcatcaccattacaagtccatgaatgttaaaatgtacaggtgggattgtgaagatttactgacatcaaaagttcttctggaaacaaacctttgttaaaaaaaaaaagtattaaattgttttaatagtgatttatttgtcatcaaatgtacaacttattctaaatattttcattttctgtgttctaaatagaaatattaagttgcagtaaaaagagaaaaaaaggctatttagcattacaaagaatcatatttaaaggctgcccaatgtagagtctagtgacctgttcaggacacctgaaatataattaaatgacaattatcaaggttttaacaatttataattctaaaccagaggattataaagaagtgcaaattgacttttacattcaactttagttaaatgaaggcactcagtattcttcctgaataatacattcagtttctcacattttatgctttcatctattcagaattatttcatagtaaaataatctactcttatcacagctgtgtgacgatttctaaatgtaggaaggcctgtgaaacatgacactgcagttaaattggttggcctaaggactaagtaatttttcttctgctgaagttttaagtgagtatttgttccaaacaagttctgttgaaatctcacgctgttgtcaggaatcagtgttatcctggaactgttattctatttaatcttcattatagcagaaatgtgccaccatggctttgacatgttggtaggtattgtcttccaggcttcaaagctgcacagagtctacgttttagagagttggcacctttgatgtggtagtgagctgatcatccactttcttctaaaataaagagaagaaaatggccagt

SEQ ID NO: 6863 - DNA, 2356 bp, Homo sapiens
agaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacaggtgggcttgggcatcagcacgctgctgatgtatgtcccaactcctctggccgccactcaccagtcaggctccttggctttgctcactggtgctctttggctgatgaatgaactccgaagagtcccaaaatgattcttagaggaccagcctcctgggactgtgactgcttttgagagctcttcagagatcataagaacttgggcttttctacgagatgaccttgacataccaagtggtttccaaatggtcaacttacttaaaaatcttttcctgttttgagatagtcactggatcaagaatgcattaagtgtggttaccctaaatgttcccttttaaatctgcttttcatgttgaaaatcagttttaatgtagagaaagaaatgtctgccatttgctgcttaacaggctttgtgtcaggtttttcagtgttggcaagctcttggttctacgtggatgatttctacgtggatgttctcctgagtccttaattctgcctaaatagaatttctttatgatcttaacttcacttccattaggtgaagattgaaaggataggattgacatacccaaagtagccagctggtcttcagcaaaaaaaaaaaagctaatgtcttctaatatcctgattttcagaaatggggaaattgcagattttgacaagcttaatgtgtatatgtagcaaaatggtttttaagtacttggaaaaggaggtaatcgccaaatagttccatttttttttttttttttgagacagagtttcactcttgttgcccaggctggagtacaatggcgtgatctcagctcactctgcaacctccacttcccaggttcaagcgattctcatgcctcagcctcccgagtagctgggactacaggcacaagtcaccatgcctggctaattttgtatttttagtagagaaggggtttcaccacattggccgggctggtcttgaactcctgacctcaggtaatccgcccatctcggcttcccaaagtgctgagattacaggcatgggccaccacgcccagctagttcctcttttgataaggctgttaacattacaaggtcagagagaggaatggaatcgacagtataaattggttcctgagagggtttcctaacagctttgtaataagaaaaatatggccttgatggtgtagtgcatggacatctacccagataaacaaattgttgactgctgaa

SEQ ID NO: 6864 - DNA, 2788 bp, Homo sapiens
agaccacagagccctgggttgtggaagaggtggctgttccctgtcatcagtatgcagcgattgctctttccgccgttgagggccttgaaggggaggcagtatctgccgctcctggctcctagggcagcgcctagagcacagtgtgattgcatcaggcgccctttgaggccagggcaatacagcaccatctctgaagtagctttgcaatctggaaggggtacagtgtcccttccctcaaaggctgctgagcgggtggtgggccgatggctcctggtctgcagtggaacagtggctggagcagttattcttggtggagtaactaggttgacagagtctggcctctcgatggtagattggcatttaataaaggagatgaagccacctacaagccaagaggaatgggaagcagaattccaaagataccagcaatttccagaatttaaaatcttgaatcatgatatgacactgacagaattcaagttcatctggtacatggagtactcacaccgaatgtggggtcgccttgtaggccttgtgtacatcctgcctgctgcctacttttggagaaagggctggctcagccgtggcatgaaaggacgtgttcttgccctctgtggcctcgtctgcttccagggtctgttgggatggtatatggtgaaaagtggactagaagaaaaatcagactcccatgacatccctcgggtcagtcagtaccgccttgctgcccacctgggatcagccctggttctttattgtgccagcttgtggacctcactgtcactgctactccctccgcacaagttgcctgaaacccaccaactcctacagttgagacgatttgctcatggaacagcaggtctggtgttccttacggccctctcaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctgggaatcacttcagtcactgccattacagtgctctacttcctctctcggagaattccccttcctagaaggaccaagatggcagcagtgactctgctggctttggcgtatacacagggccctgtcttattcaactttacttttaaaatcagtgatttggatgaaggcatcagaaacatctgatttgaggatggagcaacccaatattgctaatataatagatgacagtggcaactgaaaacagtcccagaatgaccccatcgagatgaaattaaacagattagaaatgtaacatactcatttaaattaaataagttgtataagtttgggctgaagaaacctggccttatatcatttcatataaaaaagacgggattttagttgtcctcaggttcaatatgaaccaagtagtattcatgttgttattatatgataacagaaaaattagtggtacttcaggttttatcagtagaagtgtcacagccatagtcaaaatacccctaacatactgcatttcactctgggtaccaaatttaagcaagatattgatggccactaagtgtgtatccagaagaagagatcagaatgatgagtccagaacccctgtcacacagggaataggtgaaggaactagggatatttaactggagcagagaacatctggagagagagcaagattcctgtccttgagaagttgaagccgtctcatgcagaagagggaatgagcttccattatgctgcagagctggcagcaatggatgaaagttgcaggaagttagttttagttctgtagaaggcaagagtagggtagaccaaatcaaatgctcactggggtcaggctgatggagacagtaacactggcgagcaggtgccccagctcggactatactgctgagttctggtctgttgctgccactctacaggtccagggttgttagatcttctgggtttttgttttgctttttgaaataaggaaaataagcttatcttaagtttatttttccttggatatacctagattccatacagtgacaatacaaatacaaaggaagaacatctggatttcatccttgacctcatttacaaagcaaaaagagatgctggattcagatataaatgtttaattttgcagtgtttaagtcagcaaatcttctgttttttaaaaataagccacatatctagatttttctgtgaaagctctcaattaagtgttgggaactaatttcaagattttaaaaaatgttatgcaggcttaacgtgtctgagagccataaatgacctaacgtttcccgttagtctctgaactaggtgatctcagttctctttcaactccagtactctgtaagtttctgtgacctgtagtgtaccattctcaggtggtgatatggtttggatgttttgtcccctccaaatctcatgttcaaagtgtgacattcagtgttagaggtgggcctagtaggaggtatttgggtcatgggggcggatcccttatgtatgactttgtgccatccccatagtaatgagtgagttctcactctggttgtttatgcaagagctggttgtttaaaagagcctggaacttcctcctctctcgcttgctctctctcaccatgtgacacactggctccccttcaccttctgccatgattgtaagcttcgtgaggccctcaccagaagcagatgccagcgccatgcttcctatacagttctatgcagaacagtgagccaaataaacctcttttctttctaaaaa

SEQ ID NO: 6865 - DNA, 684 bp, Homo sapiens
gcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaagatcttcagttgtgtttcttttttgtgttcctcatttgctcacgtggctttttcccccaaaggatatataccaacaaatcttgtaacataaggttcttatgttcttattactatgtcattctgggaactctggatatctgttgtcaggagaaagcagatactgacctcaaccaatgaaatctccagaattaggtgcatagaagtaaaataaccctttaccaattcagaatcagtgtggtagccatatcatctcattcaaca

SEQ ID NO: 6866 - DNA, 555 bp, Homo sapiens
tttaaattccccacctgtcagagagaagcaggacttcctgtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtgagtataggtgcttggagaggataaggaaatcaccctgatccaatagctggtaacctgcgaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacct

SEQ ID NO: 6867 - DNA, 471 bp, Homo sapiens
ggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtggtttcgtggtcgggtctctgttgacttatcccgtagcttagtaccgggaaacgatggagagagaggagaacggcaagcttcaaccactcattccttcctacaaattatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatattactagtggaa

SEQ ID NO: 6868 - DNA, 660 bp, Homo sapiens
cgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatgggtctcactctgttacccaggctggggtgaagtggcccaatcacagctcattgcagcctcaacctgggaggttcaggtgatcctcccctcagcctcctaagtaactgggactacaggtgtgggccaccgtgcctggctaattttttgtgttgttttttagagatggggtttcaccatcttgcccaggctggtctcaacctcttggactcaggcaatcctcctgccttggtctcccaaagtgctgggattaagaggtgtgagccactatgcctggccaagaaatgcttttaagtagggagtgggtatcccacggaagtattgctttctgaaaaatgaaaatggaattgtagcatgctttattcgaataaaactaaagcctcaggccattttttttttaattaaaaagtaaa

SEQ ID NO: 6869 - DNA, 6254 bp, Homo sapiens
cagggctagaatagcctttctgtgcaagtggaaaaaacctcaggtatttcccaaatcggtagctgcagaggggctctatccctaccagagatggagaaaagccctctcgcgctttttatgtcagccagagcggctcgttaagagagcgaaggccaggggctgcacaggtcgcatcccgtgagcatgaggtcagagaacctgcccctggggcaaaccgcgaggggtgggacgggtgggtgcaggcggggcggagggtaggagccgccctagtggcggcccctgggagtgtcccgtgcctcgccttaaaggagggcgccaacgcaatttcagtatgtgggagacgggctgccccacccccgcgcgcaaaaccctggtttagcttaagggatggaggcggggacccctgcgcaggcttgcggcgtgggaggcggccgcccgcgacctacgacgccgcgcgccgggaggctgagagttcggcgccgggagggtcccggggacagaagagcgcctcgcccggttgccaaggcaaccccacgcggctggagaagccggcgctcgcagcccggcccgggccgctgccggaagtgacgcgagttcacctgccgagcgggggctgggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatctttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaagcagt

SEQ ID NO: 6870 - DNA, 975 bp, Homo sapiens
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagcttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatag

SEQ ID NO: 6871 - DNA, 603 bp, Homo sapiens
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtag

SEQ ID NO: 6872 - DNA, 1080 bp, Homo sapiens
cgggagcgcgcgaggcgcggggagcctgggaccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggtt

SEQ ID NO: 6873 - DNA, 1445 bp, Homo sapiens
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaagttcaagtacccttacaagactgatggaattacagttgtataaatatggactactgaagaatctgaagtattgtattatttgactttattttaggcctctagtaaagacttaaatgttttttaaaaaaagcacaaggcacagagattagagcagctgtaagaacacatctactttatgcaatggcattagacatgtaagtcagatgtcatgtcaaaattagtacgagccaaattctttgttaaaaaaccctatgtatagtgacactgatagttaaaagatgttttattatattttcaataactaccactaacaaatttttaacttttcatatgcatattctgatatgtggtcttttaggaaaagtatggttaatagttgatttttcaaaggaaattttaaaattcttacgttctgtttaatgtttttgc

SEQ ID NO: 6874 - DNA, 270 bp, Homo sapiens
atggcgctcctgctgtgcttcgtgctcctgtgcggagtagtggatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtgggaagatgtgccacctccaaagagccgtacgtccactgccagaagctacatcggcagtaa

SEQ ID NO: 6875 - DNA, 1275 bp, Homo sapiens
gtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttccttgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatga

SEQ ID NO: 6876 - DNA, 2015 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttga

SEQ ID NO: 6877 - DNA, 413 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctga

SEQ ID NO: 6878 - DNA, 667 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcc

SEQ ID NO: 6879 - DNA, 512 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggaccaactacagtcttcccaaggattgagttatggactttgggagtgagacatcttcttgctgctggatttccaagc

SEQ ID NO: 6880 - DNA, 787 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtggtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagc

SEQ ID NO: 6881 - DNA, 1063 bp, Homo sapiens
aaggcaagagatctaggacttctagcccctgaactttcagccgaatacatcttttccaaaggagtgaattcaggcccttgtatcactggcaacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttac

SEQ ID NO: 6882 - DNA, 1709 bp, Homo sapiens
agtttcccgcccagaggcaagggcgtgcgaggggatccagatatccaaggacctgaggtttcggcctcgaggtcttgggcgggggactgggcaggctgcgcggggtcccagcgaggggacagctcgggtgggcggccagggtgttgggggctgcgggcggcggacaaagcggcggcaccaccccgcggcgcgggccaatggaatgaatgggctataaatagccgccaatgggcggcccgcgttgtgccccttaagagccgcgggagcgcggagcggccgctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctg

SEQ ID NO: 6883 - DNA, 1318 bp, Homo sapiens
gctgttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccccgcggggagcgccgcgcatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 6884 - DNA, 856 bp, Homo sapiens
gcctggagcgcgcgccggaccggccgggggtccccggcgatgatggcgctccccgcgcgcgctgcggaccccgctgaccttggccgcgtcccggggggcgccggggggcccggcggcgggggcctgagtggtacgcgggagcccgggaaccccggcgtgccggtcccctctgaccccgcgtctccccgcagcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctg

SEQ ID NO: 6885 - DNA, 759 bp, Homo sapiens
accttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaa

SEQ ID NO: 6886 - DNA, 1911 bp, Homo sapiens
ccttgcacacccacagggtagacggatcgagtttcagcttaaaccgaggggtgtgggggaagggtgttgggttcagctagtccacgtgggtgctgtcctccacttggtgctgaaatctgggcggccacatccccggggcgggagggggctacatccccggctttagacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgca

SEQ ID NO: 6887 - DNA, 1646 bp, Homo sapiens
attgcgcctctcctgcagtctgattggcaccggctcccattccggctccagcctccaatccgacccccatttcggctgcagcctcggacctagctccggccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgc

SEQ ID NO: 6888 - DNA, 1779 bp, Homo sapiens
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaagcgtggtactggaggagtggacactgctgccacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattccaaggagttctgctcattctaatgatggcccattctacttgctctggacctgccctcgcatcccctgcctccatcctagtaaagactccttgctatgctgca

SEQ ID NO: 6889 - DNA, 982 bp, Homo sapiens
tcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtgaaatacaggtaaagtacttggtccacagtaagtgcttaataagtgttaaagtgttagctgcaatattattctggatggaagagtttccccccatgttcagcacataagatatccctggtggcatggttccttctgaactacaaacaggatccctttactcatgttg

SEQ ID NO: 6890 - DNA, 1779 bp, Homo sapiens
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 6891 - DNA, 1224 bp, Homo sapiens
attgcgcctctcctgcagtctgattggcaccggctcccattccggctccagcctccaatccgacccccatttcggctgcagcctcggacctagctccggccctcggtctatccggttgcatcctccctccctgttccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagattgtgtaggggagctaggtgggaggacataaggaaaaccaaagagtagcataaatagattatgtaatttatcaaccaacccaagacatgtctgatggtaaaaaggactacctaggactcactctaggactaaaggtataaaccagctgggaccatactgggaaaaccaggacatgtggtcacactaagattaggaaaagagtgtcaggaaccttagaaagtgaagaaggcaggtaatgcaaagaaggaataactgagatggcacgtcagtgcctgggatgtgtgcagtgggatggtgaggtgtgcagataaggaaaacattcgagcttagattgatgttggcggg

SEQ ID NO: 6892 - DNA, 1372 bp, Homo sapiens
ccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctag

SEQ ID NO: 6893 - DNA, 593 bp, Homo sapiens
gtttattccgcggtttccccgcggctgcccccgggagaccgaagaggtggctggggcaggccgaaagcagaggaaaggttgggcagtgtcacccttgcacacccacaggtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaaga

SEQ ID NO: 6894 - DNA, 632 bp, Homo sapiens
actttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcga

SEQ ID NO: 6895 - DNA, 1705 bp, Homo sapiens
agcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggttctgctccgaccggaacctgtacgagctgccagtgaacgacggaggctgtatcccccgagagcaaagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttagagaagactatgtaggggagctaggtgggaggacataaggaaaaccaaagagtagcataaatagattatgtaatttaccaaccaacccaggacatgtcttatagtaaaaaggactatctaggactcactccaggactaaaggtgtaaaccagctgggaccatactgggaaaaccaggacatgtggtcacactaagattaggaaaagaaagagtgtcaggaatcttaggaagtgaacaaggctgttgacagagagtgcaaagaaggaataaatgagatggcacgtcagtgcctgggatgtgtgcagtgggatggtgaggtgtgcagataaggaaaacattcgagcttagattgatgttggcggggagaggttgctgtgttcatgactctaatataaccacccagttctgagacaaggtaggccttgactctggattctatcattcttgttaaagtatcgggtctaggctttaagttgagagttcggagagagactggggaaggtggaggatagaatggttcaagttctagaatatgtggctctagatgagaggttgaactgaatcatcaatcctacatggattg

SEQ ID NO: 6896 - DNA, 1747 bp, Homo sapiens
agacgcgcgagtctcaggtcccgctaattacctggcgggtgctgcccacccctgccctcgcgcacctagcgcggtggcaggcgggaaggcggggcctgggggagccccacccctggagactgcggctggggcctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggtggagagacttatccaagaacgtggctgggagttcatgtggaatgagcgtttgggatacatcttgacctgtccatctaacctgggcactggacttcgggcaggagtgcacatcaaactgcccctgctaagcaaagatagccgcttcccaaagatcctggagaacctaagactccaaaaacgtggtactggaggagtggacactgctgctacaggcggtgtctttgatatttctaatttggaccgactaggcaaatcagaggtggagctggtgcaactggtcatcgatggagtaaactatttgattgattgtgaacggcgtctggagagaggccaggatatccgcatccccacacctgtcatccacaccaagcattaactccccatcgccagctgatgactcaagattcccaggagttctgctcattctaatgatggcccattctacttgctctggacctgcccccgcatcccctgcctccatcctagtaaagactccttgctatgctgca

SEQ ID NO: 6897 - DNA, 1340 bp, Homo sapiens
actacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagccagacatggccaactggacagctcccaggtaactgcactaggtctaggcgtctgtgccctccctccatggttactgggtaccccctccccagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctcgagactggccagatgctcgtggaatttggcacaacaatgagaagagcttcctgatctgggtgaatgaggaggatcatacacgggtgatctccatggagaagggtggtaacatgaagagagtgtttgaaagattctgccgaggcctcaaagaggttgttgtggggattaagtga

SEQ ID NO: 6898 - DNA, 1116 bp, Homo sapiens
cttcacctcactttaccttctcctccagcacaggaactaggaactacggagagagaagccaagggagaggaggaggaggaaactaacgattccctgcccacccccacacccagcaccaccaacaggtgggcaagcttgccgagaaaacgcagagggcatcctgtgagcagcaaacacatctgagcctggaaaagacgcagagaagtaaaagatcaaagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgagcgctgagtacccagacctccgaaagcacaacaactgcatggccagtcacctgaccccagcagtctatgcacggctctgcgacaagaccacacccactggttggacgctagatcagtgtatccagactggcgtggacaaccctggccaccccttcatcaagactgtgggcatggtggctggagatgaggagacctatgaggtatttgctgacctgtttgaccctgtgatccaagagcgacacaatggatatgacccccggacaatgaagcacaccacggatctagatgccagtaaaatccgttctggctactttgatgagaggtatgtattgtcctctagagtcagaactggccgaagcatccgaggactcagtctgcctccagcttgcactcgagcagagcgacgagaggtggaacgtgttgtggtggatgcactgagtggcctgaagggtgacctggctggacgttactataggctcagtgagatgacagaggctgaacagcagcagcttattgatgaccactttctgtttgataagcctgtgtccccgttgctgactgcagcaggaatggctc

SEQ ID NO: 6899 - DNA, 1512 bp, Homo sapiens
agggaggatttccaggccggcccgaccagctcgccctgcatacacttcttggctgtgtgcgctcagcaggacgtgggaggctccggcttcaagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatat

SEQ ID NO: 6900 - DNA, 1637 bp, Homo sapiens
atacacttcttggctgtgtgcgctcagcaggacgtgggaggctccggcttcaagatcaaaggaaatgtttccctttgtcccgtttcacactaaacgggttggggaggaaccaggggagatgtcaaccgtctgccggtgactgggaagttttctgcaagtcctccacagcataggccagcaggccacttttcactaacagaagtcacaagccaagtgagacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaatat

SEQ ID NO: 6901 - DNA, 1479 bp, Homo sapiens
ctgcatacacttcttggctgtgtgcgctcagcaggacgtgggaggctccggcttcaaggtcgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcatccgtgggctgagcctgcctccagcctgcacccgggccgagcgaagggaggtagagaacgtggccatcactgccctggagggcctcaagggggacctggctggccgctactacaagctgtccgagatgacggagcaggaccagcagcggctcatcgatgaccactttctgtttgataagccagtgtcccctttattaacatgtgctgggatggcccgtgactggccagatgccaggggaatctggcataattatgataagacatttctcatctggataaatgaggaggatcacaccagggtaatctcaatggaaaaaggaggcaatatgaaacgagtatttgagcgattctgtcgtggactaaaagaagtagaacggttaatccaagaacgaggctgggagttcatgtggaatgagcgcctaggatacattttgacctgtccttcgaaccttggaacaggactacgagctggtgtccacgttaggatcccaaagctcagcaaggacccacgcttttctaagatcctggaaaacctaagactccagaagcgtggcacaggtggtgtggacactgccgcggtcgcagatgtgtacgacatttccaacatagatagaattggtcgatcagaggttgagcttgttcagatagtcatcgatggagtcaattacctggtggattgtgaaaagaagttggagagaggccaagatattaaggtgccaccccctctgcctcagtttggcaaaaagtaaactttccctttcccaatttataaataatctgtctgctggtacgacagacataaatctctactctgagagtttttatacacttggaaaaatataaaattgtagatcctgcctatctttacaataaaactctccttaat

SEQ ID NO: 6902 - DNA, 594 bp, Homo sapiens
ctgcatacacttcttggctgtgtgcgctcagcaggacgtgggaggctccggcttcaaggtcgacactcatccaagaggaaggatggccagtatcttttctaagttgctaactggccgcaatgcttctctgctgtttgctaccatgggcaccagtgtcctgaccaccgggtacctgctgaaccggcagaaagtgtgtgccgaggtccgggagcagcctaggctatttcctccaagcgcagactacccagacctgcgcaagcacaacaactgcatggccgagtgcctcacccccgccatttatgccaagcttcgcaacaaggtgacacccaacggctacacgctggaccagtgcatccagactggagtggacaaccctggccaccccttcataaagactgtgggcatggtggctggtgacgaggagtcctatgaggtgtttgctgacctttttgaccccgtcatcaaactaagacacaacggctatgaccccagggtgatgaagcacacaacggatctggatgcatcaaagatcacccaagggcagttcgacgagcattacgtgctgtcttctcgggtgcgcactggccgcagcat

SEQ ID NO: 6903 - DNA, 1655 bp, Homo sapiens
tcagctgccctccagaactcctccctggggacaacccctcccagccaatagcacagcctaggtccccctatataaggccacggctgctggcccttcctttgggtcagtgtcacctccaggatacagacagccccccttcagcccagcccagccaggtctcctacaccgccaccatgccattcggtaacacccacaacaagttcaagctgaattacaagcctgaggaggagtaccccgacctcagcaaacataacaaccacatggccaaggtactgacccttgaactctacaagaagctgcgggacaaggagactccatctggcttcactgtagacgatgtcatccagacaggagtggacaacccaggtcaccccttcatcatgaccgtgggctgcgtggctggtgatgaggagtcctacgaagttttcaaggaactctttgaccccatcatctcggatcgccacgggggctacaaacccactgacaagcacaagactgacctcaaccatgaaaacctcaagggtggagacgacctggaccctaactacgtgctcagcagccgcgtccgcactggccgcagcatcaagggctacacgttgcccccacactgctcccgtggcgagcgccgggcggtggagaagctctctgtggaagctctcaacagcctgacgggcgagttcaaagggaagtactaccctctgaagagcatgacggagaaggagcagcagcagctcatcgatgaccacttcctgttcgacaagcccgtgtccccgctgctgctggcctcaggcatggcccgcgactggcccgacgcccgtggcatctggcacaatgacaacaagagcttcctggtgtgggtgaacgaggaggatcacctccgggtcatctccatggagaaggggggcaacatgaaggaggttttccgccgcttctgcgtagggctgcagaagattgaggagatctttaagaaagctggccaccccttcatgtggaaccagcacctgggctacgtgctcacctgcccatccaacctgggcactgggctgcgtggaggcgtgcatgtgaagctggcgcacctgagcaagcaccccaagttcgaggagatcctcacccgcctgcgtctgcagaagaggggtacaggtggcgtggacacagctgccgtgggctcagtatttgacgtgtccaacgctgatcggctgggctcgtccgaagtagaacaggtgcagctggtggtggatggtgtgaagctcatggtggaaatggagaagaagttggagaaaggccagtccattgacgacatgatccccgcccagaagtaggcgcctgcccacctgccaccgactgctggaacccagccagtgggagggcctggcccaccagagtcctgctccctcactcctcgccccgccccctgtcccagagtcccacctgggggctctctccacccttctcagagttccagtttcaaccagagttccaaccaatgggctccatcctctggattctggccaatgaaatatctccctggcagggtcctcttcttttcccagagctccaccccaaccaggagctctagttaatggagagctcccagcacactcggagcttgtgctttgtctccacgcaaagcgataaataaaagcattggtggcctt

SEQ ID NO: 6904 - DNA, 10798 bp, Homo sapiens
ttttttttaattgaggaatcaacagccgccatcttgtcgcggacccgaccggggcttcgagcgcgatctactcggccccgccggtcccgggccccacaaccgcccgcgcaccccgctccgcccggccggcccgctccgcccggccctcggcgcccgccccggcggccccgctcgcctctcggctcggcctcccggagcccggcggcggcggcggcggcagcggcggcggcggcggcggaacggggggtgggggggccgcggcggcggcggcgaccccgctcggcgcattgtttttcctcacggcggcggcggcggcgggccgcgggccgggagcggagcccggagccccctcgtcgtcgggccgcgagcgaattcattaagtggggcgcggggggggagcgaggcggcggcggcggcggcaccatgttctcggggactgcctgagccgcccggccgggcgccgtcgctgccagccgggcccgggggggcggccgggccgccggggcgcccccaccgcggagtgtcgcgctcgggaggcgggcaggggatgagggggccgcggccggcggcggcggcggcggccgggggcgggcggtgagcgctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 6905 - DNA, 10035 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 6906 - DNA, 10083 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 6907 - DNA, 10083 bp, Homo sapiens; identical to SEQ ID NO: 6906

SEQ ID NO: 6908 - DNA, 1870 bp, Homo sapiens
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaactggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagccaccgaggacaccttccggatggaccgcctgtgagcgggcacgccggcaccctgccgctcagccgtcccgacggcgcctccccagcccggggacggccgtgctccgtccctcgccaacggccgagcttgtga

SEQ ID NO: 6909 - DNA, 6943 bp, Homo sapiens
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcagcgggcgggggcaggcggctcagggcacactcggccgtccctgccccatcctctggcagggctgcttttgtctttgtacctttgcatcctttgtaatgaaacgtaataaaaatccaacgttttcgtc

SEQ ID NO: 6910 - DNA, 6991 bp, Homo sapiens
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccagccgaggccagtactatggcgggtccctgcccaacgtgaaccagatcgggagtggcaccatggacctgcccttccagcccagcggatttctgggggaggccctggcagcggctcctgtctctctgacccccttccaatcctcgggcctggacaccagccggaccacccggcaccatgggctggtggacagggtgtaccgggagcgtggccggctcggctccccacaccgccggcccctgtcagtggacaaacacggacggcaggccgacagctgcccctatggcaccatgtacctctcaccacccgcggacaccagctggagaaggaccaattctgactccgccctgcaccagagcacaatgacgcccacgcagccagaatcctttagcagtgggtcccaggacgtgcaccagaaaagagtcttactgttaacagtcccaggaatggaagagaccacatcagaggcagacaaaaacctttccaagcaagcatgggacaccaagaagacggggtccaggcccaagtcctgtgaggtccccggaatcaacatcttcccgtctgccgaccaggaaaacactacagccctgatccccgccacccacaacacaggggggtccctgcccgacctgaccaacatccacttcccctccccgctcccgaccccgctggaccccgaggagcccaccttccctgcactgagcagctccagcagcaccggcaacctcgcggccaacctgacgcacctgggcatcggtggcgccggccagggaatgagcacacctggctcctctccacagcaccgcccagctggcgtcagccccctgtccctgagcacagaggcaaggcgtcagcaggcatcgcccaccctgtccccgctgtcacccatcactcaggctgtagccatggacgccctgtctctggagcagcagctgccctacgccttcttcacccaggcgggctcccagcagccaccgccgcagccccagcccccgccgcctcctccacccgcgtcccagcagccaccacccccgccacccccacaggcgcccgtccgcctgccccctggtggccccctgttgcccagcgccagcctgactcgtgggccacagccgcccccgcttgcagtcacggtaccgtcctctctcccccagtcccccccagagaaccctggccagccatcgatggggatcgacatcgcctcggcgccggctctgcagcagtaccgcactagcgccggctccccggccaaccagtctcccacctcgccagtctccaatcaaggcttctccccagggagctccccgcaacacacttccaccctgggcagcgtgtttggggacgcgtactatgagcagcagatggcggccaggcaggccaatgctctgtcccaccagctggagcagttcaacatgatggagaacgccatcagctccagcagcctgtacagcccgggctccacactcaactactcgcaggcggccatgatgggcctcacgggcagccacgggagcctgccggactcgcagcaactgggatacgccagccacagtggcatccccaacatcatcctcacagtgacaggagagtccccccccagcctctctaaagaactgaccagctctctggccggggtcggcgacgtcagcttcgactccgacagccagtttcccctggacgaactcaagatcgaccccctgaccctcgacggactgcacatgctcaacgaccccgacatggttctggccgacccagccaccgaggacaccttccggatggaccgcctgtgagcgggcacgccggcaccctgccgctcagccgtcccgacggcgcctccccagcccggggacggccgtgctccgtccctcgccaacggccgagcttgtgattctgagcttgcaatgccgccaagcgccccccgccagcccgcccccggttgtccacctcccgcgaagcccaatcgcgaggccgcgagccgggccgtccacccacccgcccgcccagggctgggctgggatcggaggccgtgagcctcccgcccctgcagaccctccctgcactggctccctcgcccccagccccggggcctgagccgtcccctgtaagatgcgggaagtgtcagctcccggcgtggcgggcaggctcaggggaggggcgcgcatggtccgccagggctgtgggccgtggcgcattttccgactgtttgtccagctctcactgccttccttggttcccggtcccccagcccatccgccatccccagcccgtggtcaggtagagagtgagccccacgccgccccagggaggaggcgccagagcgcggggcagacgcaaagtgaaataaacactattttgacggctgtcttttatatttctgagcacacacagagccctggcgtccaccggggcaggcgcaaagtggacagagcatgcagggcggcggacccccccacgaccctcctcgccctgtctccatcccctcgaagccctgcctcaccgcaggcaggcccatcggtggccacctttgccgggaagtgaccggaaggccccgtgaggggtcgaacgcggaggcaggggttacctcttggggctttacaatccgtggcccctcctgtcctgcactgtggtcaccggtcctgtcatagatgctgttaatttaaggtacaggcagaggtggccaggggagtttcattgtggtttttttttccttttagtttctagttacattttggttgtagatgactcgcttaatcttttaagccaacacttgcctgagagcatgtttttatttcagaaatccaactttacctattttttaagctaactggaaatggaggccatgcgccccaaagcagcccgccacccacctgagtgtaagaagtgagtccggcttttgggtttcaccccaagttatctcaaaacaaaagggctggtcaggctgggcagggccttgtcaggagctcacggtaggcagaggtgcctctgccagggccacagaacagacttccgggaaggggccttggcttttattgagggtctctcaaagacccagcctgccagcctctcccagaggtgcctgctagtccttagagtgtgtgtgtgaagatgccatgaccagtggcagctgagacctctctgccccaagagtgtgggggactggcagggagcgagggtccccgagacgaggaccacggtcctccctgagaacctgggtggaactggcatttcatcccctctccaccctaccctctggctcctagcccacaccccctctcttgggcagcgtggtctgctggctgccccttcttggcagctcagggtcgtggcaggtggacttggagacacacagcagtgtgtgttttagtggcaggtttcaggagcacctctaagaccagggtgacagggtacttgggagctgtcctggaccctccccataccacgggccctgcaagggaggcatcagggctggctttgttttctgctgttcttggaataggaactgctgttctgatccccccaaaactgcattgcggctctcgctcgctcctgcctgccgggacagcgccttctgctgagtccgtttatttgtagtgtcatggctgctgctttcactggggtcctgggcaccctggcttctgtcctcagagctgggtttgatcctagcaaccatcccttcctctctttgcccggcaatgcctttggcatgtgtctgagcagccaagtggccactcataggagaaggctccctggtcacgttgctcctgctgccgtcttgttccaaggtgcgggggggacactgttggtctgtccaggtcaaggtccctttctcttaccatgacagaggctgggggcagacagcggggacttttttttttttttaagaaaaactacatgtacataggagagtttcattaccattagacttgtatgtaggacttaaaaaaaaatggccttaataaaattacaagcaacccgcctggatgcggttttcaaaagaaggcattgaggaccatgctaggaaacctcataccccatccgtccaacctccggcgggcgccactgcttgtcctctggtcttcggtgtggacagataggagaggagggatgcccacctcggagcatcccaggcccgtggcccattttcagcatcctgaagccagattcacagtgacattgtgttaacgtgacgaccttggtccattatggagttctttttccaataagaacctggtggaccgaggtccgagcttgccagggacagtggggcccacgcgagtacccggggcccagccaggagccagcagccaggcgtccctgtgttccagaaggattcacgcccctcctggacctgggcgggcctcccagggggtctgtatcacggccttttgtgtgtgcgtacgtgtggtttttttaaatatcactactacatattcttgaattgccaagactttctgaaacaagacagcttaagggaatcagccttttgctttgtgatgtgaaaatactgtgatttgacgagccgcttcctgaggggcaggcccacgtggggaggttgcgccgtgtacatagacccgccgtctgtgtccttggtcaggcccggatgcttggtctacactgggttagaggctgctctccccacgcacccatgtgctcatggcttctgcagaccctctgctgggtacatcggtcccctacggcgaagttcagccagggctctccctcctgagagcatggcgtccccaccttcctgtttcgccgacgtcactacccagggtggcaagtcttgcaggcagagggtgtagcccaagttcagcctctctctgtgtcctccagagaagagggttctttgccctcatcagggccctgcttgtgggttttcggctctggggaggagagtgttggcatcagtgtgtttggcctgatttcttcagggggccaagctcccgggaggacccctagccaggagggccccccatgtccatccatccctcctgctggggcttggatgtcaggcttgggggctgtgagctgggacctcgcctgagcccggtcaggtgggacaggagcctgccagaagcccatggggggccaggccgggtggcttctattttatttttttagagatggggtcttgctgtgttgcccaggctggtctcggactcctgggctcaagcagtcctccctcctcggcctcccaaagttctggggctacaggtgtgagccacttctgcccagcatcccaggcctgaacagccttggcaggacccgtccctagagggggctctggtgcctcccttaggtgggccttgagctggtttttaaccaaacatccttccaaactcgggctgcgacctgcttcctgagttttctgtatttccaaggagccctccgaccagggagaggctggtggagtaaggtccagcggtattcgggggtcctctgtcacctcgccctgaaaacagcagctcccatcaccttcactgggtcccgatggagccgtctcagaggccgaggggccctctgtgtgggggtgggacgcaggggctctcagagcaagggccacaaagccgatggcacagatgtgcccctgggcctggcccgtcacccacatgtggtgccctgggccagggcgtgcgggcgccagagccttccctacacagcctaagagcaggggcaagactcggcccctcactcaccctgggaggcctgcctgggctacatggacacctgggtctctttctacccccattcaccatggaccaggggcctccatttcctgggggctcttgcggcatgtgatttgggggtccctgggacattctcccgtcagctccacctgagccaagtgtcctgttccctgcggcccttggccttccagggtcctggccaggcaggggtcaggcaccccatactcttccgtgtggcacaggtgtccacccacccccactggccacagacaccattctccccctgggagcaggaggtggagtaagttgtacccccaggcctgggtgctggggagttcctgagggcatgggtggggcaggagtgagtgcctcgtgatcccagcctcagtttctctcttgtcactttctcaaacctgcaggtctcagggccccgggctcctcctgggcaggatggggggcaggggctgggccttggggtggtgctggctctgatgattccagagcctgtatccaccttctgggctcctggccagcaccccacccccaggagccagggacaggtggcatgtgttggggtcgggggatggcccccatctcgaagtgttctggaatttgggggcaacccttgcccagcccagccatcaagaacttctgatctcctgcccaccaggaggggacttagccatggacttggccagtaggcctggggagggagggctttggcagccaaagtccactggccctgccgtgcccctgagtaggaaactgtcccctaggggctgggtggccccactgatatatgcaaacccgccggtccgagccctgttcctgcctgtgctcctctgtgcccaggctggctctcccccaaccctagcatgtatactctgccacggacgtcccgtgggccatgattgtgggcggccgcagcgggcgggggcaggcggctcagggcacactcggccgtccctgccccatcctctggcagggctgcttttgtctttgtacctttgcatcctttgtaatgaaacgtaataaaaatccaacgttttcgtc

SEQ ID NO: 6911 - DNA, 2644 bp, Homo sapiens
ctaggctggggccgggttcgcggtgctcgctgaggcggcggtggctacggctggaggagccgggccgaggccgcggcggaggccgcggctggtactgggagggtggcagggagggacggggaaggaagatggcgacgtcgggggcgaacgggcctggttcggccacggcctcggcttccaatccgcgcaaatttagtgagaagattgcgctgcagaagcagcgtcaggccgaggagacggcggccttcgaggaggtgatgatggacatcggctccacccggttacaggcccaaaaactgcgactggcatacacaaggagctctcattatggtgggtctctgcccaatgttaaccagattggctctggcctggccgagttccagagccccctccactcacctttggattcatctcggagcactcggcaccatgggctggtggaacgggtgcagcgagatcctcgaagaatggtgtccccacttcgccgatacacccgccacattgacagctctccctatagtcctgcctacttatctcctcccccagagtctagctggcgaaggacgatggcctggggcaatttccctgcagagaaggggcagttgtttcgactaccatctgcacttaacaggacaagctctgactctgcccttcatacaagtgtgatgaaccccagtccccaggatacctacccaggccccacacctcccagcatcctgcccagccgacgtgggggtattctggatggtgaaatggaccccaaagtacctgctattgaggagaacttgctagatgacaagcatttgctgaagccatgggatgctaagaagctatcctcatcctcttcccgacctcggtcctgtgaagtccctggaattaacatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcagggcgtccccctggataccagtaaactgtccactgaccagcggttacccccatacccatacagctccccaagtctggttctgcctacccagccccacaccccaaagtctctacagcagccagggctgccctctcagtcttgttcagtgcagtcctcaggtgggcagcccccaggcaggcagtctcattatgggacaccgtacccacctgggcccagtgggcatgggcaacagtcttaccaccggccaatgagtgacttcaacctggggaatctggagcagttcagcatggagagcccatcagccagcctggtgctggatccccctggcttttctgaagggcctggatttttagggggtgaggggccaatgggtggcccccaggatccccacaccttcaaccaccagaacttgacccactgttcccgccatggctcagggcctaacatcatcctcacaggggactcctctccaggtttctctaaggagattgcagcagccctggccggagtgcctggctttgaggtgtcagcagctggattggagctagggcttgggctagaagatgagctgcgcatggagccactgggcctggaagggctaaacatgctgagtgacccctgtgccctgctgcctgatcctgctgtggaggagtcattccgcagtgaccggctccaatgagggcacctcatcaccatccctcttcttggccccatcccccaccaccattcctttcctcccttccccctggcaggtagagactctactctctgtccccagatcctctttctagcatgaatgaaggatgccaagaatgagaaaaagcaaggggtttgtccaggtggcccctgaattctgcgcaagggatgggcctgggggaactcaagggagggcctaaagcacttgtaactttgaaccgtctgtctggaggtcagagcctgttggaaagcaggggtagaggggagccctggaagcagggcttttccggatgcctaggggtgggcagtgccagcccctcctcaccactcttccccttgcagtggaggagagagccagagtggatactattttttattaaatatattattatatgttaataaaaaaatcatatcaaa

SEQ ID NO: 6912 - DNA, 2537 bp, Homo sapiens
cgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaa

SEQ ID NO: 6913 - DNA, 5209 bp, Homo sapiens
ctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaggttgtctctgca

SEQ ID NO: 6914 - DNA, 5195 bp, Homo sapiens
ctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggttcaatttcagaagcttcagcaactgcgccttacacagtaccatggaggatccttaccaaatgtgagccagctgcggagcagtgcgtcagagtttcagccgtcatttcaccaagctgataatgttcggggaacccgccatcacgggctggtggagaggccatccaggaaccgcttccaccccctccaccgaaggtctggggacaagccagggcgacaatttgatggtagtgcttttggagccaattattcctcacagcctctggatgagagttggccaaggcagcagcctccttggaaagacgaaaagcatcctgggttcaggctgacatctgcacttaacaggaccaattctgattctgctcttcacacgagtgctctgagtaccaagccccaggacccctatggaggagggggccagtcggcctggcctgccccatacatgggtttctgtgatggtgagaataatggacatggggaagtagcatctttccctggcccattgaaagaagagaatctgttaaatgttccgaagccactgccaaaacaactgtgggagaccaaggagattcagtccctgtcaggacgccctcgatcctgtgatgttggaggtggcaatgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccagggctcatctttgaccaacttcttcccagatgtgggttttgaccagcagtccatgaggccaggccctgcctttcctcaacaggtgcctctggtgcaacaaggttcccgagaactgcaggactcttttcatttgagaccaagcccgtattccaactgcgggagtctcccgaacaccatcctgccagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatg

SEQ ID NO: 6915 - DNA, 1046 bp, Homo sapiens
atagagggaattgttcttcaggctcggaggggcctgcctgtcactgcgcccccgaccctagctcagggactgcagaactcaagataccatcccgtttctcctggctgaggaagggaagggaacatccacatcttctgtactcgtccattctgtgtccccggggcctggagtaaagacaccttcaaatgcagagactcttcagattcagctttcctggaaactgatcttcaatgcactaagagaaggagactctcaaaccaaaaatgacctggaggcaccatgtcaggcttctgtttacggtcagtttggcattacagatcatcaatttgggaaacagctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccctactcccgggctttcggagagggtgcgtccgcgcggccgcgctgctgcaggaacggcggtacctgcgtgctgggcagcttctgcgtgtgcccggcccacttcaccggccgctactgcgagcatgaccagaggcgcagtgaatgcggcgccctggagcacggagcctggaccctccgcgcctgccacctctgcaggtgcatcttcggggccctgcactgcctccccctccagacgcctgaccgctgtgacccgaaagacttcctggcctcccacgctcacgggccgagcgccgggggcgcgcccagcctgctactcttgctgccctgcgcactcctgcaccgcctcctgcgcccggatgcgcccgcgcaccctcggtccctggtcccttccgtcctccagcgggagcggcgcccctgcggaaggccgggacttgggcatcgcctttaattttctatgttgtaaataatagatgtgtttagtttaccgtaagctgaagcactgggtgaatatttttattgggtaataaatattttcatgaaagcgcctttggctccagat

SEQ ID NO: 6916 - DNA, 4370 bp, Homo sapiens
ctttccgacactctttgggaagagaatctctaatgacggcaacagtggagaacctaacgttccagaaggacactttgggaaatgctgttgacaaaaacaggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 6917 - DNA, 4406 bp, Homo sapiens
ctttccgacactctttgggaagagaatctctaatgacggcaacagtggagaacctaacgttccagaaggacactttgggaaatgctgttgacaaaaacacatccagattggagctccgttcttactcccttgcagggcgccacggctcgacagagccactcgtcctcgcctggtcatcccagttccggaggctgacctggggatgcgccctggacgccctgcaccgcagtccttgcgtcgctgctagtcagcacggcgttacccacctcatccgcagctccaggacgccgcactccacgcgctgccgcaaggaggacgcgcagcctggtcaccatggaaacggtgccgcctccgtcacggctcaagcgagaggtcaaaggtcagtcctgcaagttccgcttccggttccgagatcctgtttgttttctgaaagctttgtggtttcggtgagctctcagagccgatttctagcgtccgtgccggggacaggtgtccagaggtcgactgctgcagacatggcggcctccaccgcggccgggaagcagcggattcccaaagtggccaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaagacttttgaagataatataagaaaaaacaggactgtgattagtaactggataaaatacgcacaatgggaagaaagcctaaaggagattcaaagggctcgatccatatacgagcgtgctttagatgtagactaccgaaatattacactctggctgaaatacgcagaaatggaaatgaagaatcgccaagtcaaccatgctcgaaatatctgggaccgggccataacaacgctgcctcgagttaatcagttctggtacaagtacacgtacatggaggaaatgttgggaaacgttgccggtgcccggcaggtgtttgagcgctggatggagtggcagcctgaggagcaagcctggcactcctacatcaactttgagctgagatacaaagaggtggatcgggcccgcaccatttatgagcgatttgtcctcgtgcaccctgatgttaagaactggatcaagtatgcccgctttgaagaaaaacatgcttattttgcccatgcacggaaagtgtatgagagagctgtggaattctttggagatgaacatatggatgagcacctttatgttgcctttgccaagtttgaagaaaatcagaaagagtttgaaagggtacgagtgatttacaagtatgccctggacagaatttcaaaacaagatgcccaagaactctttaaaaattataccatctttgagaagaagtttggtgataggcggggtattgaagatatcattgtgagcaaacggagattccagtacgaagaagaagtgaaggcgaatccacacaattatgatgcatggtttgattacttgcgcttggtagaaagtgacgcagaagctgaagccgtgagagaagtctatgaaagggccattgccaatgtcccacccattcaggagaagaggcactggaagcgctacatttatctttggatcaactatgcactctatgaagaattggaggcaaaggatcctgagaggacaagacaggtgtatcaagcctctttggaactaattcctcacaaaaagttcacatttgccaaaatgtggatactgtatgcacagtttgaaatacgacagaagaatctgtcattagccagaagagcattgggaacttccataggcaaatgtccaaagaacaaattatttaaagtttacatagaattggagctacagcttcgagaatttgacagatgccggaagctttatgaaaagttcctggaatttggacctgaaaattgtacctcatggattaaattcgctgaattagagacaatccttggtgatattgacagagcacgggcaatctatgaattagccatcagtcagccacgtttagacatgccagaggtgctttggaaatcatatattgattttgaaattgagcaggaagaaacagaaagaacacgaaacctttaccggcggttgcttcaacggacgcagcatgtcaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatgggtctgatgcaggctgggaagaatactttgattacatctttccagaagatgctgccaaccaacctaacctcaaactcctggccatggccaaactgtggaagaaacagcagcaggaaaaggaggatgctgagcaccatccagatgaggacgtcgatgagagtgaatcctgatctttttttcatagacaaatgttttgttatttttataaattaattgtttggaactcttgtgactcctggaagttcttatatatttcaccagtaagaaattgattggtatctttgatggctactttttaagttattttttaaatgctcttgggttagctaggggtagggattgcaagtaaaggacttttttaactgctggatttgtttttccaactgagtccaaacttttctaatgtctgtccacatcatgcattaggaaatgtaattaaggtaacattctacagttacttttcatgtcatacccataaagatagtttatgcattcatctgaaatgtgtaactttttcatgtcttcagagtcacagacttgagttcatttcccagctctgccactcatgattatataacttaattttcattttcctcattcacaaaatgggccaatagtttgacagctcattttgaagattacattataaaaggaatatacctggtgggtgcatagtaagtgctcagtaaattgtttgttctaagccacttttaaaaatggtttcattccttgtagaattgaatgcgagtggattaataatttaccttactttcttactagtgtccagttatattgttttttagaacaacacttggaaaataatttgcagtgattatatttctgaacaaggttcagaaaacattgtttactaagaatttagtctaataatttcagttaggcgctcatcagttctccagagtggttgagtttgtaataccttgtttaaagaataatggcttgttcacgtgtgtgctatgaaaaatgatgtcccatgttcacataaatttgggaaattctggactaagacttaagtctcgttaatcaaatctctttatagttaggcttctgtacattatgtatctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctagaattatctgtttatgttgcatgaatgcataagaaaaaaattctgtcatgttcccaaggtagaattgtaataagcatgtgccagtgtgaaagctggaaggaaaaaagctattctctaacaggagaacataaagattcatttctctcccaccctcaactccaccaaagtaaatcctttcgatagtaaaagtttaa

SEQ ID NO: 6918 - DNA, 7417 bp, Homo sapiens
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtaatgatacttatgccaccgtttgtgagcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccagcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcctgatttctaatcttggttctgagagccatttggtttcagttgtagcaatccccataccagctgcctg

SEQ ID NO: 6919 - DNA, 7435 bp, Homo sapiens
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcctgatttctaatcttggttctgagagccatttggtttcagttgtagcaatccccataccagctgcctg

SEQ ID NO: 6920 - DNA, 681 bp, Homo sapiens
tggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagggactgaaaacacaccgtcgatgaaaaccagccactgatgaacagcctcagacctggccagtacggggagcacgtgaaccataactggcttagaaggactgatttcatgccaacttgaggggagaattccaaattccaaagacactcctctcacaggactatgaaaccatcttttaagaagttccaaggacaaaagtcacttccataattatagtcctggcaacttgatctttagatctatttttgcttcatctggctctggcattcccataaccttaaaaaatgttcctgttcatactagagaattcccttggcccttatttctaattgaaacctccttgaagtttctgttgctgcttttcatgcagagtgaaatacattctaacctgcagaa

SEQ ID NO: 6921 - DNA, 9023 bp, Homo sapiens
gcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctg

SEQ ID NO: 6922 - DNA, 4932 bp, Homo sapiens
tgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 6923 - DNA, 3743 bp, Homo sapiens
atgatcagaaactcactctgtcaacctagtaggtgtttggatggatacctcttttttaacagaaagatgtttggagccaggacacatggttttcacattttaatggcaatgctcataggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgc

SEQ ID NO: 6924 - DNA, 1031 bp, Homo sapiens
gaaaaggacattgatgagtgtgcctctgatccgtgtgtcaatggaggtctgtgccaggacttactcaacaaattccagtgcctctgtgatgttgcctttgctggcgagcgctgcgaggtggactactgagtggtaccagcttgctctggttggtcttcattcctgagtagttccattgtcctgaatatttatttgcctttgctatagaattcgcatcccaatgatttcaatctttccagttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccagagaataaagtcttctgtggctttagtggctatcactgaaactctttcctcttttcaacctgggaacaaattttagttttcattttaggtttctgtactttctgtagtttctgtgtaaactgccatatgtttacatggaaactacaggaaaaaattggctacatttctcacttctcctatcatgtggtcaaagttattgttgtataccagcgatgggatgtatacttttgtccttcattcatggattcagagaaagctctgggaatgacttatggtccaaaaaagtgacccaatggcaacaaataaaaattgaaatgca

SEQ ID NO: 6925 - DNA, 4691 bp, Homo sapiens
atgtgcgcgcacgccgctttacgcatgctccttaagttccccgtactccctcggagaccctagctacacgccgaatccgttactccgggttttcgcagtggctcggtggcctaccccgatcgaaacctagtctggaactgaacctacaatatctctgagggaggacacatctatgactagcagtggcatgtgctcaggaaagattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagaggcagaccaatgtgggaagggcactcactgagttgggatccagaggacctaagtaccaagtttcactgtttcgcttctgtgtaggatcttgggcaactggaaacaccttctttttatcatctataaaaccaggatccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgc

SEQ ID NO: 6926 - DNA, 2942 bp, Homo sapiens
attttgaatctaagtccctgtattttctgtgaaggagctgtaagtagggtgggacagagatggcacctgggggttctgaggcacccgctcctctctgagacagacagggatcaggagccggactgggaccagaccaccagcaacacaccagaggatgttctctaaataagaccatggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagt

SEQ ID NO: 6927 - DNA, 1671 bp, Homo sapiens
acactgcgtgaattctcctctgtgcactccattatgcttcatgggcagtgattcatgaactacagaaatggtctcagagagagccactgaagaggctggtgagaatctgctgtgcataagcaaaaactccaattgaagctgaaagtgtaaactgtgaattggaaattgacgaatgttggtcccagccttgtttaaatggtgcaacttgtcaggatgctctgggggcctatttctgcgactgtgcccctggattcctgggggatcactgtgaactcaacactgatgagtgtgccagtcaaccttgtctccatggagggctgtgtgtggatggagaaaacagatatagctgtaactgcacgggtagtggattcacagggacacactgtgagaccttgatgcctctttgttggtcaaaaccttgtcacaataatgctacatgtgaggacagtgttgacaattacacttgtcactgctggcctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgat

SEQ ID NO: 6928 - DNA, 3474 bp, Homo sapiens
actgctgtaactttcttctgcggggagggcaaaaggttcttctgctgcagcatgaaatggttgcatgctgccaactgccccgcatctgctgaaaggaggccctgctgtttatggggactgcttatggggtcaccacatagctgaccttgctctgtctcttctctatgaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttaggagcattgtgtcccttcgagatggggatccacacactgtgaatgtgatgactgtacttcaggtatctctgacatacctgacaatgttaatctgcaactgggattacactggaactacaggaatgattcctttgaccaccttaaaaactttcacagtggttccgctcgacaccattgttttattatattatatcagccaattgcaaaaaaagtctgtgccagtaatttcagccttataattagcaaaaacatcttccag

SEQ ID NO: 6929 - DNA, 3885 bp, Homo sapiens
atggcacttaagaacattaactaccttctcatcttctacctcagtttctcactgcttatctacataaaaaattccttttgcaataaaaacaacaccaggtgcctctcaaattcttgccaaaacaattctacatgcaaagatttttcaaaagacaatgattgttcttgttcagacacagccaataatttggacaaagactgtgacaacatgaaagacccttgcttctccaatccctgtcaaggaagtgccacttgtgtgaacaccccaggagaaaggagctttctgtgcaaatgtcctcctgggtacagtgggacaatctgtgaaactaccattggttcctgtggcaagaactcctgccaacatggaggtatttgccatcaggaccctatttatcctgtctgcatctgccctgctggatatgctggaagattctgtgagatagatcacgatgagtgtgcttccagcccttgccaaaatggggccgtgtgccaggatggaattgatggttactcctgcttctgtgtcccaggatatcaaggcagacactgcgacttggaagtggatgaatgtgcttcagatccctgcaagaacgaggctacatgcctcaatgaaataggaagatatacttgtatctgtccccacaattattctggatacacaggtgcccagtgtgagatcgacctcaatgaatgcaatagtaacccctgccagtccaatggggaatgtgtggagctgtcctcagagaaacaatatggacgcatcactggactgccttcttctttcagctaccatgaagcctcaggttatgtctgtatctgtcagcctggattcacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcagacagagcagattaccctcaacagtctgtgggaatgagaagacaaatctcacttgctacaatggaggcaactgcacagagttccagactgaattaaaatgtatgtgccggccaggttttactggagaatggtgtgaaaaggacattgatgagtgtgcctctgatccgtgtgtcaatggaggtctgtgccaggacttactcaacaaattccagtgcctctgtgatgttgcctttgctggcgagcgctgcgaggtggacttggcagatgacttgatctccgacattttcaccactattggctcagtgactgtcgccttgttactgatcctcttgctggccattgttgcttctgttgtcacctccaacaaaagggcaactcagggaacctacagccccagccgtcaggagaaggagggctcccgagtggaaatgtggaacttgatgccaccccctgcaatggagagactgatttag

SEQ ID NO: 6930 - DNA, 3659 bp, Homo sapiens
agtgctggttggagggacgaggggggtgcggagccagccaggccgccctcccgttctcacagcagccgagcagagcgcagagcgggctgccatggcgctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctatggtggggcagagaagtctgccaggtctgtggatgagtcgcttcccttccctggtcctcatgtccttatctgtgacatgaggaggacagtttaatttgataaatttcctgataaaatacagatcaaaacac

SEQ ID NO: 6931 - DNA, 4553 bp, Homo sapiens
atggcaatggagccgggggctctgtggaccttcctgggccacctgtggctcctggcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagacccaaggaagctgcttccagggctcgggacattgctacggaagtgtccccttggctggcagcctctgcctctgcctctgccccatcctggatggaggacgaggggagcaactcagggaaacagaggcctagagaggctgcggacttctccatcccaccctcggggttccgccttggcaggtgtacggctgtgcgtgggagggcacacgtgggttcacagtgtgttcaggagtgtgtgtatctggaggagtgtgtgtgtgagtgtgtacctgggcctgtgttagtctgcagatgctagtgtgagtgtgtcctgacatggctccagggcgtgtctgccgtgtttactgtgtgtctatgactgtgatgggtgtagctgatcccaggaggtggcggctgcgccatggggtcaaccattacagtcctagggcaggggcggcccaaggctgcatgttctccaggaggccaggccggggttgcccaggcacctccttccccgcctctgggggctgctcctgctgtggaggcagctgggaagtcagggaaggccactagcagaggctgagtgggcttctggctcctagaacaaatgtcccttcaggcaggtctgtctgccagaagccagagccagtcatgcgagggaaccacagacccacccgccccctcagccggagcagcccgagggagcagaggaggggctgcctggagcttcccaccctgctgtggtcatttgtcaaagggggaaggcacccactgcctacctcacagggctgttgtgaggatcagagaggacgacagtggggaaagaatctggaagtcttcaactgccgtctgatgggaaggaccgtctgggtgtccttctgggatgaggatgacagagcaacccttctcctgccctgaacccccccagctcacctgaccacctctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgcagaggccgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagaggcatgggtgtccagtccaatgtggggagccacgtgacaacgtgggggactgggacatgggactgggaagtcagcagacgctgggatagagagggccctgaacaccaggctcaggggcttgcttggtccttatcctgtaggaggtgggaccacctttccctgaactttctctacaacccttgggagcgtggggaggaggcggctggttccagggtcagtttactaagttagagatttggaaaacctgtgtcagctgtaactcctaggatattttatgtggaacctaacatgcagatgaaagctg

SEQ ID NO: 6932 - DNA, 5550 bp, Homo sapiens
catggcgctggccaggcctgggaccccggacccccaggccctggcctctgtcctgctactgctgctctgggcccctgccctttccctcctggctgggacggtgccttcagagccccccagtgcctgtgcctcagacccgtgcgctccagggaccgagtgccaggctaccgagagtggtggctatacctgtgggcccatggagccccggggctgtgccacccagccatgccaccacggcgctctgtgtgtgccccagggtccagatcccaccggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggcgtgacctgcgagatggaggtggacgagtgcgcctcagcgccctgcctgcacgggggctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggagccgactgcggtgtggaggtggacgagtgtgcctcacggccatgcctcaacggaggccactgccaggacctgcccaatggcttccagtgtcactgcccagatggctacgcagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgcccgctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcgaccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgcgctgatgagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactccgcagctggcctaacagtattcctgagtgagggtcggatccgggctgaggtgccgggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtcctgacccctgtttcaatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccaccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggttgcctgtcccatccaaggagtgcagcctgaatgtcacctgcctcgatggcagcccatgtgagggtggctctcccgctgccaactgcagctgcctggagggtcttgctggccagaggtgtcaggtccccactctcccctgtgaagccaacccctgcttgaatgggggcacctgccgggcagctggaggggtgtctgaatgtatctgcaatgccagattctccggccagttctgtgaagtggcgaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagacccaaggaagctgcttccagggctcgggacattgctacggaagtgtccccttggctggcagcctctgcctctgcctctgccccatcctggatggaggacgaggggagcaactcagggaaacagaggcctagagaggctgcggacttctccatcccaccctcggggttccgccttggcaggtgtacggctgtgcgtgggagggcacacgtgggttcacagtgtgttcaggagtgtgtgtatctggaggagtgtgtgtgtgagtgtgtacctgggcctgtgttagtctgcagatgctagtgtgagtgtgtcctgacatggctccagggcgtgtctgccgtgtttactgtgtgtctatgactgtgatgggtgtagctgatcccaggaggtggcggctgcgccatggggtcaaccattacagtcctagggcaggggcggcccaaggctgcatgttctccaggaggccaggccggggttgcccaggcacctccttccccgcctctgggggctgctcctgctgtggaggcagctgggaagtcagggaaggccactagcagaggctgagtgggcttctggctcctagaacaaatgtcccttcaggcaggtctgtctgccagaagccagagccagtcatgcgagggaaccacagacccacccgccccctcagccggagcagcccgagggagcagaggaggggctgcctggagcttcccaccctgctgtggtcatttgtcaaagggggaaggcacccactgcctacctcacagggctgttgtgaggatcagagaggacgacagtggggaaagaatctggaagtcttcaactgccgtctgatgggaaggaccgtctgggtgtccttctgggatgaggatgacagagcaacccttctcctgccctgaacccccccagctcacctgaccacctctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgcagaggccgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagaggcatgggtgtccagtccaatgtggggagccacgtgacaacgtgggggactgggacatgggactgggaagtcagcagacgctgggatagagagggccctgaacaccaggctcaggggcttgcttggtccttatcctgtaggaggtgggaccacctttccctgaactttctctacaacccttgggagcgtggggaggaggcggctggttccagggtcagtttactaagttagagatttggaaaacctgtgtcagctgtaactcctaggatattttatgtggaacctaacatgcagatgaaagctg

SEQ ID NO: 6933 - DNA, 525 bp, Homo sapiens
acggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctga

SEQ ID NO: 6934 - DNA, 760 bp, Homo sapiens
cggagccggtggggtcggacccacagaacgaccgacggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgt

SEQ ID NO: 6935 - DNA, 1078 bp, Homo sapiens
accgacggaccgagggttcgagggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccagaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaa

SEQ ID NO: 6936 - DNA, 2053 bp, Homo sapiens
agcttcttctagaagcaggccctgaacaggacgtgggtaagagatccgctgtcccttgagacttggcctactcccggcactccgcggacagccccagcctgcggacagccccagcctgcgtcacttgtccgcatgccagctccacccgggcggacccacacatggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctg

SEQ ID NO: 6937 - DNA, 4203 bp, Homo sapiens
gtcataggtcactgggcgggctatgggcggggtccacgtcgcctaccggggcggagcgggggtggctggagcagtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggttcctacttcagtctctggaagatttggacacaagtttaaggaaactgaactcccgcctgtttgtagtccggggacagccagccgacgtgttcccaaggctgttcaaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctggggttccccactgaaggacttggtccagctgtctggcagggaggagagacagaagctctggcccgcctggataagcacttggaacggaaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtctactggcatctgtcccttcctgtgtggaagacctcagtcaccctgtggcagagcccagctcgagccaggctggcagcatgagcagtgcaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagactgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagaacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgtcagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgagta

SEQ ID NO: 6938 - DNA, 1139 bp, Homo sapiens
agggagggctcggccttggctccacactgcgctgcccagaggccccgctgactcctgccagcctccaggtccccgtggtaccaaagctgaacatggacgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagcaa

SEQ ID NO: 6939 - DNA, 848 bp, Homo sapiens
gccattgggtgtggacagaaagctagtgaaacaagaccatgacaagtcactggccggctcagacgtgtttgtgtctctcttttcttagctcaaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagc

SEQ ID NO: 6940 - DNA, 1017 bp, Homo sapiens
gggtgccattgggtgtggacagaaagctagtgaaacaagaccatgacaagtcactggccggctcagacgtgtttgtgtctctcttttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagataactgtcttgtgtttgaatattccacacacttttaaataaatatacagataccacag

SEQ ID NO: 6941 - DNA, 965 bp, Homo sapiens
agcaagaggggagtcaggaggagtagggaacgggagggaggccacactgtagctaggaggagaaggcagctcggaagaggggaaagagaacggaaaggtaagggaggaggaggaggagaaggaggaggagggggaggaggaggaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaa

SEQ ID NO: 6942 - DNA, 887 bp, Homo sapiens
aacagggagcactgaatttgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 6943 - DNA, 624 bp, Homo sapiens
ataccttctccgaagcgctgctcacccaggcggctcgggttggcaaattcgtactcggcggtggccgggtgggcatgtggcactgagcggcccgacatggctgcagatgcagcagaagccctggtccgaggtgcagccccaacaggcgcagcgcgacccctccagctgcccggagagccagggctcgataggagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtca

SEQ ID NO: 6944 - DNA, 695 bp, Homo sapiens
agaaatgcctggaacttgccctcactgagcctaagctcggaggcccctgccctgctgccctccccagctggggcggcccgaggccggacatagtagccatggtagagtctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccc

SEQ ID NO: 6945 - DNA, 1013 bp, Homo sapiens
aaacggcctgggtggatagaagggggacaaggaggcacacccaggccggcaaagagcaggtatcagcactgcaagcaccaagtgtgtcttgagggggtggggtctttctgcccagatgtgggatcctctcctaaacccaggtcaacccagggcacgaggcagatggctgctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagcta

SEQ ID NO: 6946 - DNA, 1119 bp, Homo sapiens
ggcgcagggagcagggagatgtagacctcattgacctctgtgtccaaatgtcggccaccccgaggtgcttccaggtttaagatgccatcatgggagagagcagctcggactcgccaggggtcgacatcagcaggcaggacataggtgcggcagaactctcgggacacgaagccgtggcggtccaggcgctgggggtgccgggcagacacctccagcaggttatccacagtcctcacagtcacctcgtctgggctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacaga

SEQ ID NO: 6947 - DNA, 479 bp, Homo sapiens
aggaggaggaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcg

SEQ ID NO: 6948 - DNA, 798 bp, Homo sapiens
accagatggagacccaggctgagcagcaggagctggaaacccttccaaccaccaagatggctcagaccaaccctacgccggggtccctggggccatggaagataaccatctatgatcaggagaactttcagggcaagaggatggagttcaccagctcctgtccaaatgtctctgagcgcagttttgataatgtccggtccctgaaggtggaaagtggcgcctggattggttatgagcataccagcttctgtgggcaacagtttatcctggagagaggagaataccctcgctgggatgcctggagtgggagtaatgcctaccacattgagcgtctcatgtccttccgccccatctgttcagctaatcataaggagtctaagatgaccatctttgagaaggaaaactttattggacgccagtgggagatctctgacgactacccctccttgcaagccatgggctggttcaacaacgaagtcggctccatgaagatacaaagtggggcctgggtttgctaccaatatcctggatatcgtgggtatcagtatatcttggaatgtgaccatcatggaggagactataaacattggagagagtggggctctcatgcccagacttcgcagatccaatcgattcgccgaatccaacagtagctgattaaaagctccaagtacgataattcctcaagcatgagaccttgctaagcactctagaataagttttatgttctgctcacagacattgctttcaaatgttagctgctgaaatccacaataaacgtcatttaaaaaaaaaaaa

SEQ ID NO: 6949 - DNA, 893 bp, Homo sapiens
gccggtccatttccctcgcgtgccgcgctcacccacccggtgaatgccctctgctggggtggggaagggaggggagcgcgggaagactgcgagcccctggcagccgggtccagagctaggccgggtccagcccccgggttcttcatccgctacccaggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgcc

SEQ ID NO: 6950 - DNA, 708 bp, Homo sapiens
gcctcgcagccggtccatttccctcgcgtgccgcgctcacccacccgcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatccctgccctccatgggctgggccagcaaggatgtgggttccctcaaagtcagctccggagcgtgggtggcctaccagtacccaggctaccgaggctaccagtatgtgttggagcgggaccggcacagcggagagttctgtacttacggtgagctcggcacacaggcccacactgggcagctgcagtccatccggagagtccagcactaggctccacggccccagacaccttccctgaggacactcaataaaggttcctgaatcttcctgccc

SEQ ID NO: 6951 - DNA, 493 bp, Homo sapiens
ccctcgcgtgccgcgctcacccacccggttgggcaggctgtgtgtggctcgaaacggggctcttgagacgctgagcgcgtggtgccacccttcctgtccgcagcggcatgagcagcgcccccgcgccgggcccggcgcccgccagcctcacgctctgggacgaggaggacttccagggccgtcgctgtcggctgctaagcgactgtgcgaacgtctgcgagcgcggaggcctgcccagggtgcgctcggtcaaggtggaaaacggcgtttgggtggcctttgagtaccccgacttccagggacagcagttcattctggagaagggagactatcctcgctggagcgcctggagtggcagcagcagccacaacagcaaccagctgctgtccttccggccagtgctctgcgcgaaccacaatgacagccgtgtgacactgtttgagggggacaacttccaaggctgcaagtttgacctcgttgatgactacccatc

SEQ ID NO: 6952 - DNA, 811 bp, Homo sapiens
acatgttccctgggcctatctcggaaggggccacaatgaccctgcaatgcacaaagtcagcgggaccctggaagatggtggtgtgggatgaggacggcttccagggccggcggcacgagttcacggccgagtgccccagcgtgctggagcttggcttcgagactgtgcgatctttgaaagtgctgagtggagcgtgggtgggctttgagcatgctggcttccaagggcagcagtacattctggaacgaggcgaatatccaagctgggatgcctggggcggcaacacggcctaccccgccgagaggctcacctccttccggcctgcggcctgtgctaaccaccgtgactcgaggctgacaatcttcgagcaagagaacttcctgggcaagaaaggagagctgagcgatgactatccttccctccaggccatgggatgggaaggcaatgaagtagggtccttccacgtccactctggggcctgggtttgctcccagtttccgggctaccgaggatttcagtatgtgctggaatgcgatcaccattccggtgactacaaacatttccgggagtggggctctcatgccccgaccttccaggtgcagagcatccgcaggatccagcagtgaacaggggtgcggcacggaggagcgcatgcgtgcttatctgcaatggaggcgctctggaggctgtggtgtgttctctccttctgcctccccctgtaacctgtgtgaacccagcacccatgtgaactggtccgtgcacagtcagcacaaaaaactcaaacgaataaaaaagagaaagtctggtatta

SEQ ID NO: 6953 - DNA, 1102 bp, Homo sapiens
acagactatagggcctgatgtctgccagactataaaatggggggtcggactctagtcacccatagcacctgcccgcctgcctgtcctccagcaggaagtagcaagtccccagacttttgcaggcgggaaccatgtctcaggctgcaaaggcctcggcctcggccacagtggcggtgaacccagggcctgacaccaaggggaagggggccccacctgcaggaacatcccctagtcccggcactaccctggccccaacaaccgtgcctattaccagcgccaaggcggcggaactgcctcctgggaactacaggctggtggtcttcgaactggaaaacttccagggccgtcgagcagaattctcgggggagtgctcaaatctggcagaccgtggcttcgaccgtgtgcgcagcatcattgtctccgcgggaccctgggtcgcctttgagcagtccaacttccgcggggagatgttcatcctggagaagggcgagtaccctcgctggaacacatggtcgagcagctaccgcagtgatcggctcatgtccttccggcccatcaaaatggatgcccaggagcacaaaatctccctgtttgaaggggccaacttcaagggcaacaccatagagatccagggggacgacgcacccagtctctgggtctacggcttcagtgaccgcgtgggcagcgtgaaggtctccagtggaacatgggttggctatcagtatcctggctaccgcgggtaccagtacctcctagagcctggtgacttccggcactggaatgagtggggagccttccagccacagatgcagtccctgcgtcgcctgcgtgacaagcagtggcacctcgaggggtccttccctgtcctggccacagagccccccaagtgagtccacacctcactctgctaccttgccccaacccttcttcatgttcaattatttcccccatttttcccaggcaaataaaattccctaaagccaaaatttctcctggatctgtaaacagatgtgtgccttgaggtcccccatagttactgggatgtgacttcctcgctcttaataattacaacgataataaaagcagcaaacactgaaaagtt

SEQ ID NO: 6954 - DNA, 886 bp, Homo sapiens
ggtgagagcttaatccagcattctcaccctgcttttcgcaggagcacagcggtcactcatcttggcaccggcacttctggggaaggtataaatgccacctcccgctggccgagcttcacggcactcgcaggggctggtgtcactggtcattcctgcacaggacagtccaccatggcctcagatcaccagacccaggcgggcaagccacagtccctcaaccccaagatcatcatctttgagcaggaaaactttcaaggccactcgcatgagctcaatgggccctgccccaacctgaaggaaactggcgtggagaaggcaggttctgtcctagtgcaggctggaccctgggtgggctatgaacaggccaactgcaagggcgagcagtttgtgtttgagaagggtgagtacccccgctgggactcatggaccagcagccgaaggacggactccctcagctccctgaggcccatcaaagtggacagccaagagcacaagatcatcctctatgaaaaccccaacttcaccgggaagaagatggaaatcatagatgacgatgtacccagcttccacgcccatggctaccaggagaaggtgtcatctgtgcgggtgcagagtggcacgtgggttggctaccagtaccccggctaccgtgggctgcagtacctgctggagaagggagactacaaggacagcagcgactttggggcccctcacccccaggtgcagtccgtgcgccgtatccgcgacatgcagtggcaccaacgtggtgccttccacccctccaactagtgccctccccaccatgcctccttcccaggacccaggtctgctgcccaggaaccctccagacctcccagagagtgaataaagtgtgacttgcaacttg

SEQ ID NO: 6955 - DNA, 867 bp, Homo sapiens
agacaggcgagtctgcagacggccgtggctcctctgttcttcccgaggctacagcaacagccagaggtgttcctggggagatggcggaacagcacggagcacccgaacaggctgcagctggcaagagccatggagaccttgggggcagctacaaggtgatcttgtacgaactagagaacttccaaggcaaacgctgcgagctctcggccgagtgccccagcctgaccgacagcctgctggagaaggtgggctccatccaagtggagtccgggccgtggctggcatttgagtccagggccttccgcggggagcagtttgttctggagaagggggattatcctcgctgggatgcctggtccaacagccgtgatagtgacagccttctgtccctccggcctctgaatattgatagtccacatcacaagctgcatctgtttgagaacccagctttcagtggccgcaagatggagatagtggatgatgacgtgcccagcctgtgggctcatggcttccaggaccgtgtggcgagtgtccgtgccatcaacgggacgtgggttggctatgagttccccggctaccgtgggcgccagtacgtgtttgagcggggcgagtaccgccactggaatgagtgggacgccagccagccgcagctgcagtctgtgcgccgcatccgtgaccagaagtggcacaagcggggccgcttccccagcagctgaaaggcacccagacttcaaggacccagacccaccctggggggctgcaagggcaagaagaggaggctccagggttggggcgagggccgacctgtccacccttccctggaatctgctcaataaagcctggggttggtcccccacccgccacgtt

SEQ ID NO: 6956 - DNA, 609 bp, Homo sapiens
atcaccctctgtcaacaaccatggggaagatcaccttctacgaggaccgagactttcagggtcgctgctacaattgcatcagtgactgccccaacctgcgggtctacttcagccgctgcaactccatccgagtagacagcggctgctggatgctctatgagcgtcccaattaccagggccaccagtacttcctgcgccgaggcaagtaccccgactatcagcactggatgggcctcagcgactcggtccaatcctgccgtataattcctcataccagctcgcacaagttaaggctgtacgagagagatgactaccgaggccttatgtctgagctcactgatgactgcgcctgtgttccagaactgttccgtctccctgagatctattccctccacgtactggagggctgctgggtcctctatgaaatgcccaactaccgggggcggcagtatctgctgaggcctggggactacagaaggtaccacgactgggggggtgcagatgccaaagtcggctctttgagacgggtcaccgatttgtactaagctgtgcctgccttgttgtgatccccatagaaacataataaatatacaagttgtgttccctgca

SEQ ID NO: 6957 - DNA, 641 bp, Homo sapiens
ccgcagtcccacacagcaaccagaaaacatctgctcacttccttcaaaatgggaaagatcaccttctacgaggacagggccttccagggccgcagctacgaatgcaccactgactgccccaacctacaaccctatttcagccgctgcaactccatcagggtggagagcggctgctggatgatctatgagcgccccaactaccagggccaccagtacttcctgcggcgtggggagtaccctgactaccagcaatggatgggcctcagcgactccatccgctcctgctgcctcatccccccgcactctggcgcttacagaatgaagatctacgacagagatgaattgaggggacaaatgtcagagctcacagacgactgtatctctgttcaggaccgcttccacctcactgaaattcactccctcaatgtgctggagggcagctggatcctctatgagatgcccaactacagggggaggcagtatctgctgaggccgggggagtacaggaggtttcttgattggggggctccaaatgccaaagttggctctcttagacgagtcatggatttgtactgaagtatttacgttttccacttttctcctttaaaatctaataaaatatttagcttgtgtttctggca

SEQ ID NO: 6958 - DNA, 629 bp, Homo sapiens
ccatcacactgaactcgcatcatccgtgtcaaccagccatggggaagatcaccttctatgaggacagggccttccagggccgcagctacgaaaccaccactgactgccccaacctgcagccgtatttcagccgctgcaactccatccgggtggagagcggctgctggatgctctatgagcgtcccaactaccaaggtcaacaatacttgctgcggcgaggggagtaccccgactaccagcaatggatgggcctcagcgactccatccgctcctgttgtctcatcccccaaacagtctcccacaggctgcggctgtacgagagggaagaccacaaaggcctcatgatggagctgagtgaagactgccccagcatccaggaccgcttccacctcagcgagatccgttccctccacgtgctggagggctgctgggtcctctacgagctgcccaactaccgggggcggcaatacctgctgaggccccaagagtacaggcggtgccaggactggggggccatggatgctaaggcaggctctttgcggagagtggtggatttgtattaaaatagcttaacactaccaatttcccattttggaacctaataaatatttagtctgcattgctggcaa

SEQ ID NO: 6959 - DNA, 619 bp, Homo sapiens
ctcagcaccgccgtgcgcccagccagccatggggaagatcaccctctacgaggaccggggcttccagggccgccactatgaatgcagcagcgaccaccccaacctgcagccctacttgagccgctgcaactcggcgcgcgtggacagcggctgctggatgctctatgagcagcccaactactcgggcctccagtacttcctgcgccgcggcgactatgccgaccaccagcagtggatgggcctcagcgactcggtccgctcctgccgcctcatcccccactctggctctcacaggatcagactctatgagagagaggactacagaggccagatgatagagttcactgaggactgctcctgtcttcaggaccgcttccgcttcaatgaaatccactccctcaacgtgctggagggctcctgggtcctctacgagctgtccaactaccgaggacggcagtacctgctgatgccaggggactataggcgctaccaggactggggggccacgaatgccagagtgggctctctgaggagagtcatagatttctcctgaaatatgtcctcttttgttgtttcttaatttggaaactaataaaatattttctgtgtgttcctggca

SEQ ID NO: 6960 - DNA, 759 bp, Homo sapiens
ctattctcatgactaagcaaatgtttgactgaaaccagcccatataaatgtcactgtgcctctaactctctgtagccattcctgaatttctttcagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatccca

SEQ ID NO: 6961 - DNA, 1132 bp, Homo sapiens
cccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaagcactgggaaaaccagtctatgcaccaaaaatgtctaaaactggaaccaagattactttctatgaagacaaaaattttcaaggccgtcgctatgactgtgattgcgactgtgcagatttccacacatacctaagtcgctgcaactccattaaagtggaaggaggcacctgggctgtttatgaaaggcccaactttgctgggtacatgtacatcttaccacagggagagtaccctgaataccagcgttggatgggcctcaacgaccgcctcagctcctgcagagctgttcatctgcctagtggaggccagtataagattcagatctttgagaaaggggattttagtggtcagatgtatgaaaccaccgaagattgcccttccatcatggagcaatttcacatgcgagagatccactcctgtaaggtgctggagggtgtctggattttctatgagctacccaactaccgtggcaggcagtacctcctggacaagaaggagtaccggaagcccatcgattggggtgcagcctccccagctgtccagtctttccgccgcattgtggagtaatgacatgaatggggccatattcttcctggggcccaaatgctggctggccttgtggtccaaataggcatcatcaataaaacagttggcatgcatcccactgctgactataatgcctctccttaaatgcttctagggaccagcaatacagtgctcgccacagtgggcagtcacacaaagctacccatctgccagatcaccaatctagatctttgtgccaaacaaaatgagatctcattaaaaggttagaaagtcata

SEQ ID NO: 6962 - DNA, 1485 bp, Homo sapiens
agagctcgcagctccgccggcgcctggtcccagcgcccgcggcgccgcgtccccggcccaaccatggcgtcctccgcggccggctgcgtggtgatcgttggcagtggagtcattgggcgaagctgggccatgctgtttgccagtggaggcttccaggtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgatcgagtgatcttaagcagttccacttcttgtctcatgccttccaagttgtttgctggcttggtccatgtgaagcaatgcatcgtggctcatcctgtgaatccgccatactacatcccgctggttgagctggtcccccacccggagacggcccctacgacagtggacagaacccacgccctgatgaagaagattggacagtgccccatgcgagtccagaaggaggtggccggcttcgttctgaaccgcctgcaatatgcaatcatcagcgaggcctggcggctagtggaggaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccagtgaatttcttgtaatgcagcttccactcctctcattggaggccctatttgggaacactgcaagcccttaatcagccctctgtgacataggtagcagcccacggagatcctaagctggctgtcttgtgtgcagcctgagtggggtggtgcaggccggtagtctgcccgtcactttggatcatagccctgggcctggcggcacagcagcacttgcgttctcggggctgtcgatttcctgccacctgggcagataacctggagattttcaccttttcttttcagcttgattgcatttgactatattttacagccagtgattgtagtttcatgttaatatgtggcaaaatatttttgtaattattttctaatccctttctgagtactctggggccctgcatttatgaggcacctaccttcattttgctaacgcttattctgaataaaagtttttgattccttaaagaca

SEQ ID NO: 6963 - DNA, 1471 bp, Homo sapiens
cttgtctgccactatgtgagatatacctttcaccttctgccgtgattgtgaggcctcctcagccacgtggaactgtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgca

SEQ ID NO: 6964 - DNA, 1273 bp, Homo sapiens
ataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgc

SEQ ID NO: 6965 - DNA, 1273 bp, Homo sapiens; identical to SEQ ID NO: 6964

SEQ ID NO: 6966 - DNA, 1400 bp, Homo sapiens
gtaaaaactcctggaagaaaagatcctgcaatttggctttttgtgagatggaaaagattacaccttgccctgcaaacttcccccctttaaaggcgaaggtttgttagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccaccgtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 6967 - DNA, 1888 bp, Homo sapiens
agaaggtgtggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaa

SEQ ID NO: 6968 - DNA, 888 bp, Homo sapiens
gcacatcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtga

SEQ ID NO: 6969 - DNA, 1292 bp, Homo sapiens
tggcagtcctcatttctgtggaatctgaagaagcccacgcagattttaattcccactctagattctgtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaaggttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaa

SEQ ID NO: 6970 - DNA, 1588 bp, Homo sapiens
agtcctcatttctgtggaatctgaagaagcccacgcagattttaattcccactctagattctggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaattaaaa

SEQ ID NO: 6971 - DNA, 2301 bp, Homo sapiens
agtaggatgcggccagcgcaggagctggtggtgaaaaactgatctcgcatgttcagaaactgcacaagctctaccacatcctcgtcaacactgcccttccggctgaggtccgctttgctcaaacattgcgccttccatttcctgaactccgcgctgcgatccatgggtgacggactcagggtctgcgctcggctccttcatggtagcctcgtctctccctgggggcagccatattgaagcgagcggtggccgaaaaggtccaaacttcctcttcgttcttaatttgggaaattctagtgccttcgcctaggggtggagagaggcgcacatcctgggtggagcgaggcgcacatcctgggtggagcctgcaaaagttggagaaggtgtggcagtcctcatttctgtggaatctgaagaagcccacgcagattttaattcccactctagattctggcttcatcgttatgaagcatatgatgatcccgtggatagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattgataaaattaagaagtatgttggtgagaaaggaattgatataattattgaaatgttagctaatgtaaatcttagtaaagacttgagtcttctgtcacatggaggacgagtgatagttgttggcagcagaggtactattgaaataaacccacgagacaccatggcaaaggagtcgagtataattggagttactctcttttcctcaaccaaggaggaatttcagcaatatgcagcagcccttcaagctggaatggaaattggctggttgaaacctgtgataggttctcaatatccattggagaaggtggccgaggctcatgaaaatatcattcatggtagtggggctactggaaaaatgattcttctcttatgatgattaattctttcatggatttcctatgtaattagaggtactgtctttcccccagttgtacttaccctatcttttctttaattaacattcgattccatgagcttcttatgtgaaaaaataagatttttctttagagagcagaagcagaagagtaaaatttattgtatagctagcaatatttttttatgccatctgtctcaaatcaaagagtcatcatagtaggaaataacatgttagttgtcatttggcatgagtgtgcattccagtaattcttaattgatatttgattaattccatacctttgattaaaacatgctagttcaaaataagactgctcagtttccaagggttttcaagcctacttacctttataaaggttctctagtctctgattagccatgactgtattggactttgaacattttctgaactaaaaacctctattctaaactaatctcatttggatgtgtaagtcttttgtaaaggcaagaataaataatatccaggacaatttattagttttctcagtattttcccaaatattagaatatttacttcattattggttggctgccaatgaccccatatgttctgtgagaatagtagctttatctttgatataatacatagtctccaaataggtaatacttcgcaattgattagattttcagagtagatttagagttatctgtttttctggtgagggtcaaatatttttgttaattaagctcacaaatttgataaattaagaattatctgcatttgtctcgtaacataataatgtgtaataaagtctatagaaaatt

SEQ ID NO: 6972 - DNA, 677 bp, Homo sapiens
aagccattcccctccaggggctgcaagttcccatccataaatcagtatctagatcaccatggcgactggacagaagttgatgagagctgttagagtttttgaatttggtgggccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcactagcagcacgatctctgggggttatgcagagtatgctcttgcagcagaccacactgtttacaaactacctgaaaaactggactttaaacaaggagctgccatcggcattccatattttactgcttatcgagctctgatccacagtgcctgtgtgaaagctggagagagtgttctggttcatggggcaagtggaggagttggattagcagcatgccaaattgctagagcttatggcttaaagattttgggcactgctggtactgaggaaggacaaaagattgttttgcaaaatggagcccatgaagtgttcaatcacagagaagtgaattacattg

SEQ ID NO: 6973 - DNA, 1617 bp, Homo sapiens
agcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacagggaaaatatctttgtatcttaaaggatgtgatggagaagttatcaactggtgttttcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaa

SEQ ID NO: 6974 - DNA, 607 bp, Homo sapiens
ggtggctcatgcctgtaatcccagcatttcgggaggccgaggcagacggatcacaaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagata

SEQ ID NO: 6975 - DNA, 620 bp, Homo sapiens
ccgttccacgggattagcaaaactgcctccccgctgacagaactgagaatttctagaggcatttgtttgtatgggatttgctgttattatctaccctcttcattggccttgcctttattatctgtacgttttgatcaagaggagcagcaagagaagaatgccaacagacaagcacaaagaaacgcatctggccggagcctgcatgtatctaaatttccaggttgctgctgccctcagaatagcactgatgatggcaaagttctagaggaaactttcatattgaagaggctataaaaatctctatagcctccaactccacagagaagccgctaatctatttcttccaaagcaaagccttcttgagtctgaatcacaacaaaagattgcccataggaaatgtaatctccgaagttgttttctaatcccaaggcaagcagaagcgcaggaaggtgcggccgattcctcgccggtttcctttttttgggaattcggattgcattcgtgcaagcaagggactgcaattgtgtcttgggtccacaccacaaaaccgtgtcggtgactatgaaaggcttatatttccaacagagttccacagatgaagaaataacatttgtatttca

SEQ ID NO: 6976 - DNA, 2571 bp, Homo sapiens
actggccccgcccaccgtgcgaacccaaagagggtgagccaaagaaatgtaagacaacagagtgacaagccgaatgagccaatcagcaggggctgtgtgggggcaggattagcactctccccctcctccccatgtaggcgtaacaggagatttatggtctgaggttgcctatcgtggtttatggagattttgttgcacgatttcggtgcatctgctcgttgccgtgagagacactagataggatgcacttaattgacttaattattggaggttttcaaggagagaataatgtggaaaggaaaaaggcgaagcacaacccaaaggggttggccgggcctatggttggaatgaggaagggtgtggtcttcggctaaaatttgcataaaacggaacccatccgggcgattccaacttcgcccatttattggtagtccttggggcggggcctcgcctctttctccgcccccgagcggaacatgacgggagatgtagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgactatgaaaggcttatatttccaacagagttccacagatgaagaaataacatttgtatttcaagaaaaggaagatcttcctgttacagaggataactttgtgaaacttcaagttaaagcttgtgctctgagccagataaatacaaagcttctggcagaaatgaagatgaaaaaggatttatttcctgttgggagagaaattgctggaattgtattagatgttggaagcaaggtatcattctttcaaccagatgatgaagtagttggaattttgcccctggactctgaagaccctggactttgtgaagttgttagagtacatgagcattacttggttcataaaccagaaaaggtcacatggacggaagcagcaggaagcattcgggatggagtgcgtgcctatacagctctgcattatctttctcatctctctcctggaaaatcagtgctgataatggatggagcaagtgcatttggtacaatagctattcagttagcacatcatagaggagccaaagtgatttcaacagcatgcagccttgaagataagcagtgccttgaaagattcagacctcccatagagaacagtacaattgcctgatttcctgtcctttacagcccgagtgattgatgtatctaatgggaaagttcatgttgctgaaagctgtttggaagaaacaggtggcctgggagtagatattgtcctagatgctggagtgagattatatagtaaagatgatgaaccagctgtaaaactacaactactaccacataaacatgatatcatcacacttcttggtgttggaggccactgggtaacaacagaagaaaaccttcagttggatcctccagatagccactgccttttcctcaagggagcaacgttagctttcctgaatgatgaagtttggaatttgtcaaatgtacaacaggttaagtttccttaagtattccaaacagtattccaagtgccttgcaagtattcatttaaacattaaaacagccttttgagatgtaagtactgttatcatccccatttcacaggtgaagaaacagaagcacagagatgttgatacagactcaaggacgcagcaagtggcggagcaagaatcacactcaggcagtctctctcctttctgaacagagatgagccctaagatacctggaagattttgtttttaacctcacattaaggaaagcacacatcaccttgaaaggttgcacacttactcctatgatggtgccattgcacagaaacatttcagaatacttttctaaattaaagagtttgtggagtgttttataaatatcaatgctaggaaatctttatcaaatgaagataggtttgactttttgaaacaaaagtcattcagagataagtctggtgtgattgaagccaaatcattccagttgagtaaaaataataaaaagtttggaatatacaaacaatttcaaaaagaaaggtgcaaacctctttagagtagggtcaacttaagaattccttttatttctaaaatgactggcttagaggcagcagcacttggtaaaagttttaatgtattggataaaaaaaaagttatcattacttgatagagcatatgtgtgtgtctgaagaaagatttacatagccttacacttctctctactgaatatcatacgttacttttcttaaatgtgtctagtcatatatgtgtgatatgtataaaggccagttccctccaggagcaatgacagtctttattcggagctttaaggtagttatgtaggccgggcatggtggcacatgcctgtaatcccagctactcatgaggctgaggcagaagaatcgcttgaacctgggaggcagaggtttcagtgagccaagattgcactactacactccagcctggtgacagagtgagactccatctc

SEQ ID NO: 6977 - DNA, 3553 bp, Homo sapiens
gtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaa

SEQ ID NO: 6978 - DNA, 2749 bp, Homo sapiens
atggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaa

SEQ ID NO: 6979 - DNA, 3055 bp, Homo sapiens
tcaggctcgctgtcgcgccattttgccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgttgaagatgaaccaaacaaaatttgtgaagccgatcgagtggccattaaagccaacatagtgcacttgatgcttagcagcccagagcaaattcagaagcagttaagtgatgcaattagcattattggcagagaagattttccacagaaatggcctgacttgctgacagaaatggtgaatcgctttcagagtggagatttccatgttattaatggagtcctccgtacagcacattcattatttaaaagataccgtcatgaatttaagtcaaacgagttatggactgaaattaagcttgttctggatgcctttgctttgcctttgactaatctttttaaggccactattgaactctgcagtacccatgcaaatgatgcctctgccctgaggattctgttttcttccctgatcctgatctcaaaattgttctatagtttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaagagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacct

SEQ ID NO: 6980 - DNA, 2689 bp, Homo sapiens
gccggggtttgaatgtgaggcggagcggcggcaggagcgggtagtgccagctacggtccgcggctggggttccctcctccgtttctgtatccccacgagatcctatagcaatggaactcagcgatgcaaatctgcaaacactaacagaatatttaaagaaaacacttgatcctgatcctgccatccgacgtccagctgagaaatttcttgaatctgttgaaggaaatcagaattatccactgttgcttttgacattactggagaagtcccaggataatgttatcaaatttaaactttcaggatctccctgaattttttgaagataatatggaaacttggatgaataattttcatactctcttaacattggataataagcttttacaaactgatgatgaagaggaagccggcttattggagctcttaaaatcccagatttgtgataatgccgcactctatgcacaaaagtacgatgaagaattccagcgatacctgcctcgttttgttacagccatctggaatttactagttacaacgggtcaagaggttaaatatgatttgttggtaagtaatgcaattcaatttctggcttcagtttgtgagagacctcattataagaatctatttgaggaccagaacacgctgacaagtatctgtgaaaaggttattgtgcctaacatggaatttagagctgctgatgaagaagcatttgaagataattctgaggagtacataaggagagatttggaaggatctgatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaagcatggaattacacaagcaaatgaacttgtaaacctaactgagttctttgtgaatcacatcctccctgatttaaaatcagctaatgtgaatgaatttcctgtccttaaagctgacggtatcaaatatattatgatttttagaaatcaagtgccaaaagaacatcttttagtctcgattcctctcttgattaatcatcttcaagctgaaagtattgttgttcatacttacgcagctcatgctcttgaacggctctttactatgcgagggcctaacaatgccactctctttacagctgcagaaatcgcaccgtttgttgagattctgctaacaaaccttttcaaagctctcacacttcctggctcttcagaaaatgaatatattatgaaagctatcatgagaagtttttctctcctacaagaagccataatcccctacatccctactctcatcactcagcttacacagaagctattagctgttagtaagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatgatgtgcaagaatttattccatacgtctttcaagtgatgtctttgcttctggaaacacacaaaaatgacatcccgtcttcctatatggccttatttcctcatctccttcagccagtgctttgggaaagaacaggaaatattcctgctctagtgaggcttcttcaagcattcttagaacgcggttcaaacacaatagcaagtgctgcagctgacaaaattcctgggttactaggtgtctttcagaagctgattgcatccaaagcaaatgaccaccaaggtttttatcttctaaacagtataatagagcacatgcctcctgaatcagttgaccaatataggaaacaaatcttcattctgctattccagagacttcagaattccaaaacaaccaagtttatcaagagttttttagtctttattaatttgtattgcataaaatatggggcactagcactacaagaaatatttgatggtatacaaccaaaaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctg

SEQ ID NO: 6981 - DNA, 2740 bp, Homo sapiens
ccgggccgcgcttcctctcgccaggcctgcgagcttcctcccagcggagccctgggcgagccgaggttggccgccgccgccgccgagcccgctgccgccctcccgctcctgccccacccgcgccttgcccgggggcttctgccggggtggggtccgagccgggcgaccgcccggctgcgccgccgtcggggccgtaacccggcccgccgtccctcccgccccagccagcctctggccgccggagcccgcggggcgtggagcgcgaggagccccgcggccccgatcgagcgtccggggcggcccccggcagccagcgcgacgttccaaaatcgaacctcagtggcggcgctcggaagcggaactctgccggggccgcgccggctacattgtttcctccccccgactccctcccgcccccttcccccgcctttcttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccgag

SEQ ID NO: 6982 - DNA, 2281 bp, Homo sapiens
aggggtctcatgaccccaccagggaggagccgtccaagagagttagcagctcccacttgcaagatgtctgtggcaaggcaggcactgttctggtgctgagagctcaactccagtcctcacagcagcccccagagccaaggagtatcaccagtccattgcacagatggggaagctgggttctagagtcacagccagcagagtaaagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgcc

SEQ ID NO: 6983 - DNA, 2219 bp, Homo sapiens
ccgggccgcgcttcctctcgccaggcctgcgagcttcctcccagcggagccctgggcgagccgaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagatcacacgggagcaggctgagcggcttctgtacccgccggagacaggcctgttcctggtgcgggagagcaccaactaccccggagactacacgctgtgcgtgagctgcgacggcaaggtggagcactaccgcatcatgtaccatgccagcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctggcctcccgccactcgccttcttagagttttattcctttccttttttgagattttttttccgtgtgtttattttttattatttttcaagataaggagaaagaaagtacccagcaaatgggcattttacaagaagtacgaatcttatttttcctgtcctgcccgtgagggtgggggggaccgggcccctctctagggacccctcgccccagcctcattccccattctgtgtcccatgtcccgtgtctcctcggtcgccccgtgtttgcgcttgaccatgttgcactgtttgcatgcgcccgaggcagacgtctgtcaggggcttggatttcgtgtgccgctgccacccgcccacccgccttgtgagatggaattgtaataaaccacgccatgaggacaccgccgcccgcctcggcgcttcctccaccg

SEQ ID NO: 6984 - DNA, 1728 bp, Homo sapiens
cttccctccgcgacccgggccgtgcgtccgtccccctgcctctgcctggcggtccctcctcccctctccttgcacccatacctctttgtaccgcaccccctggggacccctgcgcccctcccctcccccctgaccgcatggaccgtcccgcaggccgctgatgccgcccgcggcgaggtggcccggaccgcagtgccccaagagagctctaatggtaccaagtgacaggttggctttactgtgactcggggacgccagagctcctgagaagatgtcagcaatacaggccgcctggccatccggtacagaatgtattgccaagtacaacttccacggcactgccgagcaggacctgcccttctgcaaaggagacgtgctcaccattgtggccgtcaccaaggaccccaactggtacaaagccaaaaacaaggtgggccgtgagggcatcatcccagccaactacgtccagaagcgggagggcgtgaaggcgggtaccaaactcagcctcatgccttggttccacggcaagctcagcatcgacgaggaggtgtactttgagaacctcatgcagctggtggagcactacacctcagacgcagatggactctgtacgcgcctcattaaaccaaaggtcatggagggcacagtggcggcccaggatgagttctaccgcagcggctgggccctgaacatgaaggagctgaagctgctgcagaccatcgggaagggggagttcggagacgtgatgctgggcgattaccgagggaacaaagtcgccgtcaagtgcattaagaacgacgccactgcccaggccttcctggctgaagcctcagtcatgacgcaactgcggcatagcaacctggtgcagctcctgggcgtgatcgtggaggagaagggcgggctctacatcgtcactgagtacatggccaaggggagccttgtggactacctgcggtctaggggtcggtcagtgctgggcggagactgtctcctcaagttctcgctagatgtctgcgaggccatggaatacctggagggcaacaatttcgtgcatcgagacctggctgcccgcaatgtgctggtgtctgaggacaacgtggccaaggtcagcgactttggtctcaccaaggaggcgtccagcacccaggacacgggcaagctgccagtcaagtggacagcccctgaggccctgagagagaagaaattctccactaagtctgacgtgtggagtttcggaatccttctctgggaaatctactcctttgggcgagtgccttatccaagaattcccctgaaggacgtcgtccctcgggtggagaagggctacaagatggatgcccccgacggctgcccgcccgcagtctatgaagtcatgaagaactgctggcacctggacgccgccatgcggccctccttcctacagctccgagagcagcttgagcacatcaaaacccacgagctgcacctgtgacggctggcctccgcctgggtcatgggcctgtggggactgaacctggaagatcatggacctggtgcccctgctcactgggcccgagcctgaactgagccccagcgggctggcgggcctttttcctgcgtcccagcctgcacccctccggccccgtctctcttggacccacctgtggggcctggggagcccactgaggggccagggaggaaggaggccacggagcgggaggcagcgccccaccacgtcgggcttccctg

SEQ ID NO: 6985 - DNA, 1109 bp, Homo sapiens
tgagattagggggcgcagccagagcaggcctaggaaaacgccagcagcgtgtggcgatcacggtgatgaagcgcaatggtggccgccccgtgggctacccaggagcaggaggagggccgagggatccagcccggggaccggggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggcc

SEQ ID NO: 6986 - DNA, 3538 bp, Homo sapiens
ggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaa

SEQ ID NO: 6987 - DNA, 3753 bp, Homo sapiens
ggaagtcggcgcgggctaggcgacgggtggaagccggtaccgagaggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccaggagcggttctggtgaggttggaaggatgcagccacccggttgtcatgaaaggcctgtgtgctgaatgtggccaagacctcacccagttgcagagtaagaacgggaagcagcaggtgccgctgtccacggcgaccgtgtccatggtgcacagcgtgccggagttgatggtgagctccgagcaagctgaacagctgggaagagaagaccagcagcgactgcaccgaaaccggaagctggtgctcatggtggacttggaccagacgttgattcacacaaccgagcagcactgtcagcagatgtcgaataaaggcatctttcacttccagctgggccggggtgagcccatgctgcacacgcgcctgcgtccacactgcaaggacttcctggagaagatcgccaagctgtacgagctgcacgtcttcaccttcggcagccggctgtacgcacacaccatcgcaggctttttagaccccgagaagaagcttttttctcaccgaatattatcaagggatgaatgtattgacccattttctaaaacgggaaaccttagaaatctctttccttgtggagactcaatggtttgcattattgatgatcgagaagatgtctggaagtttgcccccaatctgataactgtgaagaaatatgtatacttccagggcacgggtgatatgaatgcgccccctgggtcccgagaatctcagacgagaaagaaagtaaatcattctcgaggcactgaggtctcagagccatctccgcccgtgagagaccctgagggggtaacgcaggcccctggagtggagcccagcaatggcctggagaagcctgcacgggagctgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcagagcggttccgccaccccagccgcagatgtttggtgaagagctgcctgacgctcaggacggagagcagcctggcccttctagaagaaagcgacagcccagtatgtctgagacaatgccgctgtacactctttgtaaggaggatttagagagtatggacaaagaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctct

SEQ ID NO: 6988 - DNA, 2638 bp, Homo sapiens
cgcctagccgcgccggtcccagaagtggcgaaagccgcagccgagtccaggtcacgccgaagccgttgcccttttaagggggagccttgaaacggcgcctgggttccatgtttgcatccgcctcgcgggaaggaaactccatgttgtaacaaagtttcctccgcgccccctccctccccctcccccctagaacctggctcccctcccctccggagctcgcggggatccctccctcccacccctcccctcccccccgcgccccgattccggccccagccgggggggaggccgggcgcccgggccagagtccggccggagcggagcgcgcccggccccatggacagctcggccgtcattactcagatcagcaaggaggaggctcggggcccgctgcggggcaaaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaagcagaccccagtccaatacctgctccctgaggccaaggcccaggactcagacaagatctgcgtggtcatcgacctggacgagaccctggtgcacagctccttcaagccagtgaacaacgcggacttcatcatccctgtggagattgatggggtggtccaccaggtctacgtgttgaagcgtcctcacgtggatgagttcctgcagcgaatgggcgagctctttgaatgtgtgctgttcactgctagcctcgccaagtacgcagacccagtagctgacctgctggacaaatggggggccttccgggcccggctgtttcgagagtcctgcgtcttccaccgggggaactacgtgaaggacctgagccggttgggtcgagacctgcggcgggtgctcatcctggacaattcacctgcctcctatgtcttccatccagacaatgctgtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggcccagaagttggggggagggagggaaaggatttttacattttttaaactgctattttctgaatggaacaagctgggccaaggggcccaggccctgtcctctgtccctcacacccctttgctccgttcattcattcaaaaaaacatttcttgagcaccttctgtgcccagcatatgctaggcccaccagctaagtgtgtgtggggggtctctacgccagctcatcagtgcctccttgcccatccttcaccggtgcctttgggggatctgtaggaggtgggaccttctgtggggtttggggatctccaggaagcccgaccaagctgtccccttcccctgtgccaacccatctcctacagccccctgcctgatcccctgctggctgggggcagctcccaggatatcctgccttccaactgtttctgaagcccctcctcctaacatggcgattccggaggtcaaggccttgggctctccccagggtctaacggttaaggggacccacataccagtgccaagggggatgtcaagtggtgatgtcgttgtgctcccctcccccagagcgggtgggcggggggtgaatatggttggcctgcatcaggtggccttcccatttaagtgccttctctgtgactgagagccctagtgtgatgagaactaaagagaaagccagaccccta

SEQ ID NO: 6989 - DNA, 3065 bp, Homo sapiens
cgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 6990 - DNA, 3652 bp, Homo sapiens
atgcacgtgaatgcctctgcccgacggtgggggcggggaggggctgcagcactaccaggcccggcagccagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccctgcaccgctgcgcgcgcagccccgcccccccccccggcccgcccccggcccgcccccgccgcggaagggcggctgcggcggccaatggcgagctccccaggacaggacgcgggggctgcggagcaggaactcgccccgcccacccctcgcgcagccccgcctccgccacgccaaccaatggcgcgcgccgccgggcacgccggctgctgattggcggcgcccggcacgctcggggcgggcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacgcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggttctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctgggcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgt

SEQ ID NO: 6991 - DNA, 3150 bp, Homo sapiens
gcgggaggttcggagcgggagctcgggctcgcggacggtatggaggactacgagcaggagctgtgcggcgtcgaggatgatttccacaaccagttcgcggccgagctggaggtgctggcagagctggaaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacggagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcagggctctctcctccacgtcccatggcgaggcggtggccagctggacctgctgggtgtgtccttagcctccctgaagaagcaggtcgacggcgagcggcgggagcggctgcttcaggaggcccagaagctttcagacaccctgcacagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtggcactgctctgtgggcccccggggctggggaagaccaccctggcacacgtgattgcgcgtcacgcggggtactctgtggtggagatgaacgccagtgacgaccgtagcccggaggtcttccgcacacgcatcgaggcggccacccagatggagtcggtgctgggtgctggcgggaagcccaactgcctggtcatcgatgagatcgacggggcccccgtggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagttcgcaccgtccctgcggcagctgaagcagcaggccttcctgctccacttcccgccgactctgccctcgaggctggtgcagcggctccaggaggtctccctgcggcagggcatgagggccgacccaggggtgctggccgccctctgtgagaaaactgacaatgacatccgggcctgcatcaacaccctgcagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagcacacagctgtacagcacccgtgaaaagcaacagctggccagcctggtgggcacgatgctcgcttacagcctgacctaccgccaggagcgcacgcccgatggccagtacatctacaggctggagccgaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtggatgggagccccccagggctcgagggtctgctggggggcattggggagaaaggggtgcaccgacctgccccacgcaaccatgagcagcggctggagcacatcatgaggcgagcggcccgggaggaacagcctgagaaggacttctttggacgtgtggtcgtcaggagcacagcagtcccgagtgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaa

SEQ ID NO: 6992 - DNA, 2903 bp, Homo sapiens
agtgctcgcggcggcggcgacggcggcgggaggttcggttgtcgcccgttggccgcgcggcgccgcgctcggcggccgccattgcagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctttttagggacaaaccctgcccccaggtcaggtgtgtttccaggcccaggccttgggcccaacccaagaccaagtggcctgggcccaggccctaatctagatgccagagcaggtggcctcttgggcacaggatctggtcttaacttaagaatggctggacctcaaggcctcgatcttgcccccattctaagagcagcaggtcttttaggagcaaattcagcttctttctcacaggcttctggaaacatgggcacaagcccatcctccatggcaagagtacctggccccatgggcccaaactcgggtcctagctctcggggaattggccttccagggccaaatccatctcccatgtcaagggctcctggccccataggccctaattcagctcatttctcaaggccagttggccccatgggggtaaatgccaatccctttcccaggggagcaggttcatctgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggc

SEQ ID NO: 6993 - DNA, 1073 bp, Homo sapiens
gggtggccgagcgcgggcggaggacggagaagggggcggcgagggccggaatctcgagcttgttttcacttgctttttaaagacagaaagctcatggtgcaaattgttatttccagtgcgagggctggaggcctggcagaatgggtgctgatggagctacagggggagatcgaggctcgctacagcactggattagctggaaacctcctgggagacctacattacaccactgagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggc

SEQ ID NO: 6994 - DNA, 2903 bp, Homo sapiens; identical to SEQ ID NO: 6992

SEQ ID NO: 6995 - DNA, 2037 bp, Homo sapiens
gaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggt

SEQ ID NO: 6996 - DNA, 3199 bp, Homo sapiens
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaaga

SEQ ID NO: 6997 - DNA, 1712 bp, Homo sapiens
actggctgtccggggctccgcgcgcgtcgccggcccagctctgtcgctgacgggaggatctgaagccggccgcagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagcta

SEQ ID NO: 6998 - DNA, 1232 bp, Homo sapiens
cataatttggcttcacatggaacgttcctgaggaggaaaatgtcctgaccatgccaaagtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcg

SEQ ID NO: 6999 - DNA, 3629 bp, Homo sapiens
gggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccccagcccgacaggtgagcgccaggccagccgcggggtggagcccgccgtgcccaccggccaccctccccggtgctaccaccaccgcgcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggga

SEQ ID NO: 7000 - DNA, 1787 bp, Homo sapiens
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaataagcttgtcccttgggctggcctcagtagaacacactgaatgcccctccgcatttgatctgcgtgactccctgttcattgggctgttttgtgagttaccgatgctcctggagatgaacttggactgggacttggactga

SEQ ID NO: 7001 - DNA, 3526 bp, Homo sapiens
aaaggcaggcattctctttccttttccttctctcctgagcgctcctgcagttcctggggcgtagtaggggatccacaagcgtttgtgaccagtgaagttctttacaagggtgagatctgcacgggaggacccgagcgagggtctcggcttgccaggaagccggggttccccgggaagcgtggagttcacccgcgcactcgaagtgcctttgcaaaattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttggga

SEQ ID NO: 7002 - DNA, 4319 bp, Homo sapiens
tcctttgtccgctctctgatggcgccggctccctgcccagcgctgagtcgggtccggccgccagccccgcgctcgcagacctcggctgccgggtgtggcgcggggactggggaacgctggcccgtgcccagtgcggttggagcctgtcccgcgcgtccccgggacgcgcttcttcccgcctccgcccgcgccagcgcccgcacccggatccccacttctcccggccctcgggagccaggagagccctgagatggcgttggcggaagtgaagccccgagcgggggtctgcgaggctggtgatcagcgccggtaacatggcctttctgtcctctccccggtcccagtgcaccccttaaacaacgacccccgcgttttccccgtactagatggttagggcgcatagtgccgaactacgctgctgctacagaatagcttttttgggggcaacataaaaaagaattgtatgtatggtttatatacaacaaaatgtcccattttcagtgtgcaaatcgacgggatttgacaaattatacactcctgtaaccattatcccaaagtgaacattgaccatttccttcaccctgcaaagttccctggtacctcctttctgtcaatccaccccaggccccgcactcaaccccggttctgattgttatcatagcttagctttgactgttctagaacttcatagaacaagatcatcagattatatctgggtgttggcacccagccactattctgccaatgaagtacatcctggtcacgggtggggtcatctcaggcattggtaaagggatcattgccagcagcattggaacgattctaaaatcatgtggactccgagttactgccataaaaatcgacccctatattaacatcgatgctggcactttttcaccttatgaacacggtgaagtcttcgtcttaaatgatggtggagaagttgatttagaccttggaaattatgaaagatttttggatattaatctttataaagacaacaatatcaccacggggaagatatatcagcatgtgatcaataaagagaggcgtggtgattacctggggaaaacagtgcaagttgtccctcacattactgatgctgtccaggagtgggttatgaatcaagccaaggtgccggtggatggtaataaggaagagccccaaatatgcgttattgagctgggaggcaccattggagacatcgaaggaatgccgtttgtggaggcgtttagacaattccagtttaaggcgaaaagagagaatttctgtaatatccacgttagccttgtcccacagctcagtgctaccggagaacaaaaaaccaaacccacccaaaacagcgtccgcgcactgaggggtttaggcctgtctccagatctgattgtctgccgaagttcaacgcccattgagatggccgtgaaggagaagatttctatgttttgtcacgtgaaccctgaacaggtcatatgtatccatgatgtttcttccacataccgagttcctgtgcttttagaggaacaaagcattgtgaaatattttaaggagagattgcacctgcccatcggtgattctgcaagtaatttgctttttaagtggagaaatatggctgacaggtatgaaaggttacagaaaatatgctccatagccctggttggcaaatacaccaagctcagagactgctacgcctctgtgttcaaagccctggaacactcagccctggccatcaaccacaagttgaatctgatgtacatagactccattgatctggagaagatcactgaaaccgaggaccctgtgaaatttcatgaagcttggcagaagctatgcaaagctgatggtattcttgtgcctggaggctttggaatcagaggaacattgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaaggaaactttatggtgatgttccttttatagaagaaagacacagacatcggttcgaggtaaaccctaacctgatcaaacaatttgagcagaatgacttaagttttgtaggtcaggatgttgatggagacaggatggaaatcattgaactggcaaatcatccttattttgttggtgtccagttccatcctgagttttcttctaggccgatgaagccttcccctccgtatctggggctgttacttgcagcaactgggaacctgaatgcctacttgcaacagggttgcaaactgtcttccagtgatagatacagtgatgccagtgatgacagcttttcagagccaaggatagctgagttggaaataagctgaaatgaatacatgactgggaataatggggactgcctgtgaggcctctgaaataattgaaggcaagatgaaggaactatctgaagaaatcactacactcttagagaatccctctgttctccagcaaacatgggatgtaaagcctcacagggaatctgataatacatacttctgtcaaccagaaccagaggggtagttttcttttccctccagaggcagcctttggtacttaaaatatctgtagctgattaaatttttcccaacaacctcactggggagaaagtgtgttcatgttttgtccagcggatcaggatgttaggatgacgagcaagagtccaggtcactgtgcctttgctgtgttgtatggaaaggatggcagggaacatgctgtaagtaattttgagtaagaaaatgagtcactgtgttacctggaactcagccacagatttgtgtgtggtccaagatcattgcagtttctcaccctgtttatttcctggtaaaagtaaaattgaataggtccaagacttgggggtggcaagtaaggctttgcctcaggcacaaaatttaagggggctccaaaaaactcaggaatcaagatcagcaatacagtctgagtatcccttatgtgaaatgcttggggctagaagtgttttgaatttcagattttggaatatttgcatatacatgcgatatcttggggatgagactcaagactaaacatgaaattcatttatgcttcatatacaccttatatacatagcctaaaggtaatttgatacaatattttaaataattttgtgcatgaaacaaagtttcgactgcattttgactgtgatttctggcatgagatcagttatggaattttccacttctagcgtcatgttggcattcagaaattttgaaattttggagcattttggattttcagattagggatgctcaacctgtatatatattttttaatcgacgtgaaattcacgtaacatagaattaaccattttgaagtgaacaatttggttgcattcactgatgttgagcaaccaccacctttaactatttccaaaacattttcatcactccaaaataaatgcctgtacacactagcagtcactccctatcttcccctccacctgtccgctggcaaccactgatctcctttttatttctgtggctttttctattctggatatttcatataagtggaattacacaatatatgtggtcttttgtgtctggcttcttctgagacagtaggaaggggggcttggctttggctcacccccactagagcattttttcatgcattcccactgatcacaaaacccatactactacctcattgacaccatacctgctaacctcgaggctttagtcatacaaagaaaatggcctttctgtattgttcttctgtgctctcataatgcttaaccatgtcttttacttaaacaattccaggaactggccttaggagatccaaatagggaaccaagattgcagagtgtcccatcttgggagggaatgctgaataattaattgatttacagccttgttgccgctggccagaccaccaggtggcccattactcgagatgatcatcacaaccagatgatgctaacctatatcctctacccttcgcgtgctttgtctgggaagtcttttggccccatgtcagtttctattgcattgagagcccaagagcccctggtcagtcaggcttccatttagcatggcgtttgcaaggtttacccatgttgtagcatgtgtcagaatttcattcctttctatggctgaataaaattccattgtatgaatatacc

SEQ ID NO: 7003 - DNA, 733 bp, Homo sapiens
tgggaaaactccaggcgatttcttgggcaaggacaaagaagattccttttctgggagtttgtcttgggatgcaactagcagtgatagagtttgcaagaaactgccttaacttgaaagatgctgattccacagagtttaggccaaatgccccagttcctctggtgattgatatgcccgagcacaaccctggcaatttgggaggaacaatgagactgggaataagaagaactgttttcaaaactgaaaattcaatattaataagcttgtcccttgggctggcctcagtagaacacactgaatgcccctccgcatttgatctgcgtgactccctgttcattgggctgttttgtgagttaccgatgctcctggagatgaacttggactgggacttggactgattcacactcagttcttttgaatccacagttctctccattacatttgaaccggttccctgtttaatgtctgtttgcctggtcttagtgactcacaaatgaacttccgagtaggagggcagttatgcacctcagaagcgtatttctctgttccctggcagccccagtgtggggagatggctcgccatttgatatttgctgatctttccactccccataaggttaattctaatttctgtggaactttttcataaattagcatattatataagaataacttattgtttaaaacaaactaaagcctttaattcaatttaataaatgtatcttgagtgccc

SEQ ID NO: 7004 - DNA, 7071 bp, Homo sapiens
ccccatccccacccccaagcgagcacctgcccctcccgggggcggagctccggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagaaacaagctcagaggtgtgcagcgaaacctggctgggagtctagttcgattgagtgctctggtgaaaagtaaacagaaagcttacttcatcctgtctcttggtagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcatagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcagggaaagtgcactcgcctgggctccacttgccctacgcagacagctataagccaggccatcatcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttctcactggtactcatctctggggtcccaggcctcctgactcctagttgtccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttcctattccctgaatcactagcgctcccgaaggcttggagggaggagtctctgggcacccgggtgaaaggaaggttcacgtgcaaccgccgcgtctttttttccctgaagcgctttcatggaggcagatgtttgtcagtcaagggaagtaagaaaggcattggatgaaaacgaagccctaagcctcgtagtcgtggccgagtggttaaggcgatggactagaaatccattggggtctccccgcgcaggttcgaatcctgccgactacgtcatatttttttcttcagcatactgaccatatttctctccaggatgggatgatccagtcggcaccctccaaacctctcatctaggaactctagaatcgagaatttgatttagagtctatgattttggtttgaaatctatgattaacgtctttggacattgaaggaaatccgaggaatggacaagtgatgcaagagccagttgagttaccaaattagttctagaaagatctgaaaaagctcggtccgggttcctagctctatattcttgtagatgaatttcaggaacctttatggcagcttcggcgccgtggcttagttggttaaagcgcctgtctagtaaacaggagatcctgggttcgaatcccagcggtgcctttattcaattgaaacagcgtgattttgcggctaaatccacatcctttcatgtattgtttttatatcagaacgcgtaagagtttctgttctgcactcatagcacccacatttcctgcagagtcaagctgccactcccatgagatcgccactctaaaaggtggttctctaacttaggggcagaaatgttgcataggcctaagggtcctttgcttaactgatgccacaccccactggtgcaggtggactgggtcaggcggccgccccaccctcgatggaaggggctgcccaccttccaggcctctttctccaccctaggacgtcccctagaacctgagccactttgttttgtttggctcttcattatagttctttgggtttggtggctcataatgttatatatatagtatataatataaaaatatatatttaaatatacagtatttaaaatttggcacagcttccagatgcggtcctctaactggtctttcacttgcagttacctccatccctctccaccagcgggatgtcagggtaaggagtaagcagggatccggctggcctggcctggcctggcaccaggtttcgtgcagcagggtgcagaagggctgaggccatgtgaacagagtccaagaaagcatcattcgggagtcgctagggatcctggtgtggaagggcagggcacttttctggagcactgaagctaggctggttaaggaagaaataaatgccagagataaggcaagaaataggatctgtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtagaaacttgccatgtatggccgggcgcggtggctcacgcctgtaatcccagcgctttgggaggccaaggtgggcggatcacgaggtcaggagttccagaccagcagcctggccaacatagtgaaacctggtaacatagtgaaacctcgtctctactaaaaatgcaaaaaattagccaggcgtggtggcaggcgcctgcagtcctagctacttgggaggctgaggcaagagaatcgcttcaaccttggaggggggaggaggtgttgtcagccgagatcgcgccactgcatcccagcctgggcaacaagagtgaaactccgtctcaaaaaaatgaaataaaataaacgaatgatc

SEQ ID NO: 7005 - DNA, 6901 bp, Homo sapiens
ccccatccccacccccaagcgagcacctgcccctcccgggggcggagctccggcgcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcaggaacggaagcctctatgtgagagataacactggcgtcctgagctgtgagctcatagacctggacctttcttggttgggccatctttttctgttcccccgttggagttacctccctcctgccaggtggaattcctcaggggaagggcacttggagctgtgggatgcccctgtgccagtgtttcctttgaccatcagtcctggccccgtcacgcctatccctgtcctctacccagagagtgcttcctgcctgctcaggctcagatcacacccagctgtcacccacgtgtccatcatcgtgcaggtccctgcccagctggtgtggcacagagcccttcggcctggtacagcctatgtgctgacagaactgcgagtgtccaagatccgtggtcagcgccagcatgtttggatgaccagtcagtcctcccgtctgttgctgctgaaaccagaatgtgtgcaggagctggaactggagctggaaggacccctcttagaggctgaccccaagccactccccatgcccagcaactcggaggacaagaaggatccagaaagtcttgtccggtattctagactcctatcctattcgggagcagtcactggcgtgttgaatgagcccgctggcctctatgagctggatgggcagctggggctctgccttgcctaccagcagttccgtggccttaggcgggtgatgcgacctggagtgtgtctgcagctccaggatgttcacctgctccagtcagtgggaggggggacaagaaggccagtgctcgccccctgcctccgtggcgccgttctgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagctgtgtccccatgtgctgagacaccaccagttcctgcaacattcctctcctgggagccccagcctgggactgcaactcctggctcctaccctggatcttctagctccgccaggcagccctgttcggaatgcacacaatgagatccttgaagagccacatcactgtcccctccagaaatacactcggctgcagactccctcctccttccccactctggccaccctgaaagaagaaggacagcgtaaggcctgggcctcctttgaccctaaggcccttctgcccctcccggaggcctcctacctgcccagctgccaactcaatcgccgcctggcttggtcctggctctgtctgctgccctctgccttctgcccagcccaggttttacttggggttctggtggcttcatctcataaaggttgtctgcaacttcgggaccaaagtggttccctgccctgcctgctcctggccaagcactctcaacccctcagtgacccacggctgataggctgcctggtgcgggcagagaggtttcagttgatcgtagagagggacgtgagaagcagcttcccttcctggaaggagctgagcatgccaggcttcatccagaagcagcaggccagagtctatgtccagttctttctggctgatgccctgatcctgcctgtgcccagaccctgccttcattcagcaacaccctcaacacctcagacagatcccaccggcccagagggaccccacctaggacagagccggctcttcttgctctgccacaaggaggccctcatgaagcgtaatttttgtgtccccccaggagcaagtccagaggtgcccaagcccgccctcagtttctatgtgttggggagctggcttgggggcacccagaggaaggagggtactggatgggggctgcccgagccccagggaaatgacgacaatgatcagaaggttcacctcattttctttggctcttcagtccgctggtttgagttcttgcacccgggacaggtgtaccgactcatagctcctggccccgctacaccaatgttgtttgaaaaggatggttcatcctgcatatctcggcgtcctctggagttggctggctgtgcatcctgcctcactgtccaggacaactggactctggagcttgaaagctcccaggatatccaagatgtgctggatgcaaacaagtcattgcctgaatcctcactgaccgacctgctcagtgacaatttcacagattccttggtgtctttctccgctgagattttgtcacggacactatgtgaaccccttgtggcgtctctctggatgaaactggggaacacgggggccatgagaaggtgtgtgaagctaacagtcgctcttgagactgctgaatgtgaattcccccctcacctggatgtatatatagaagacccacacttgcctccctcactaggactacttccaggagcccgggtccacttcagccagttggagaaaagggtttccagatctcacaatgtttattgttgtttccggtcatccacttatgtgcaggtcctgagttttccccctgagaccaccatcagcattcccctgccccacatctacctggctgaacttctgcagggtggtcagtccccattccaggccactgcctcttgccatatcgtctctgtcttcagccttcagctcttctgggtgtgtgcttattgtaccagcatctgccggcaggctcctggtggaggatgggactgccgaagccgtggtgacctgtaggaatcaccatgtggcagcagcactagggctgtgtcctagagagtgggcctccctcctagatttcgtccaagtgccaggcagagtggtcttgcagtttgcagggcctggagcccaacttgagtcttcagccagggttgacgagcccatgaccatgttcctctggacactttgtactagcccctctgtcctccgtcctattgtgctttcttttgagctggaaaggaaaccgtcgaagatcgtcccattagaacctcctcggctacagcgattccagtgtggagagctccctttcctgactcacgtgaaccccaggctccgattgtcctgcctttctatccgagagtcagagtactccagctctctggggatccttgcttcctcctgttaactgaactgcaaggatggcctgagagtccttccttgctgaaaacctgaaggcctaggtcctggctcctctccctacttgttctgtgattgaaccaaggactccagattcacaaactgctactccactataatttcccttctttggtgttctggtgccagcctgccttggcaaaattgtggcaacaggaaatcatggccctattaatatgtcctctgattgggacaaggcacctgcattcacaggcggccctgagcacctgggttctgactttgtcgcaggagctgagggaacaaaagacttgctcgctgtggggtgatggtgacaggcctattgacctgcaatgaagccctctggtgtcatttctcactggtactcatctctggggtcccaggcctcctgactcctagttgtccacctcctaggaactcctagtcgttcatcatcatttcagccctttgccgccagggccaaaggtggaaagtgatttggaagagaagagcttttcgtccagcagaagaaatggtaccaaaatcagtctgtaaaggaagtaaattggggagttggcggcaaggcagagagcatagctatgatggtctcagtcagtaaggctgggccctgcaggaagtcaaatatgaatgcctagaggtgttcacaagcacaaagaaggtgtagggggaggcaagtgccaggcacaagcaggggcaggtgaggactctgggtgactgtgctatagggccccaggctacggttagccctgtaggtttcccaagggcctggcctaaggcagatccttgatcgatataccttgagaccagaaggtgctccgaaatcacaaccgtacaattaggggatctaggaacaattctttggagataccaatgcctttggctggtgttgctgcatttctttactggggactgatagatggagaggtggaaagatgagctgaggcacatctttcagagctactgggaggccatttcttcctggctgttaggatttgttcgtgtttgggagacctttagagcgtggttaaacccatatgttgggatttatgctgcttttatggtagcaataccctatattaagatttgaagtagacccggaaagttagtggccggttagctcagttggttagagcgtggtgctaataacgccaaggtcgcgggttcgaaccccgtacgggccagtgggtggcttttttttgtgtgtgttttgttttctgaccctctgctgttatccggaagtttctacccggagccagttgccttctggtaacagaattatattgcacctactgcttcctattccctgaatcactagcgctcccgaaggcttggagggaggagtctctgggcacccgggtgaaaggaaggttcacgtgcaaccgccgcgtctttttttccctgaagcgctttcatggaggcagatgtttgtcagtcaagggaagtaagaaaggcattggatgaaaacgaagccctaagcctcgtagtcgtggccgagtggttaaggcgatggactagaaatccattggggtctccccgcgcaggttcgaatcctgccgactacgtcatatttttttcttcagcatactgaccatatttctctccaggatgggatgatccagtcggcaccctccaaacctctcatctaggaactctagaatcgagaatttgatttagagtctatgattttggtttgaaatctatgattaacgtctttggacattgaaggaaatccgaggaatggacaagtgatgcaagagccagttgagttaccaaattagttctagaaagatctgaaaaagctcggtccgggttcctagctctatattcttgtagatgaatttcaggaacctttatggcagcttcggcgccgtggcttagttggttaaagcgcctgtctagtaaacaggagatcctgggttcgaatcccagcggtgcctttattcaattgaaacagcgtgattttgcggctaaatccacatcctttcatgtattgtttttatatcagaacgcgtaagagtttctgttctgcactcatagcacccacatttcctgcagagtcaagctgccactcccatgagatcgccactctaaaaggtggttctctaacttaggggcagaaatgttgcataggcctaagggtcctttgcttaactgatgccacaccccactggtgcaggtggactgggtcaggcggccgccccaccctcgatggaaggggctgcccaccttccaggcctctttctccaccctaggacgtcccctagaacctgagccactttgttttgtttggctcttcattatagttctttgggtttggtggctcataatgttatatatatagtatataatataaaaatatatatttaaatatacagtatttaaaatttggcacagcttccagatgcggtcctctaactggtctttcacttgcagttacctccatccctctccaccagcgggatgtcagggtaaggagtaagcagggatccggctggcctggcctggcctggcaccaggtttcgtgcagcagggtgcagaagggctgaggccatgtgaacagagtccaagaaagcatcattcgggagtcgctagggatcctggtgtggaagggcagggcacttttctggagcactgaagctaggctggttaaggaagaaataaatgccagagataaggcaagaaataggatctgtgagctcttggcaggacctaaacctccttggaagataggcagaaagctctcgacaccattccatggcccacgaaccaatgtaagatgagcaaatggcttgaaggaattgctacctccaggtcaagccagggatgcagcactgccgagaccacgtttgtgccaagcactgggctggaccctgtgcagaaccaaatgaacaaggcacgttcccctttcagcactaacggcactgtaagaacagggagaagtggaatctaatctggcctgagggtagagggtgatcagctaagtctgaaacaccatgtagaaacttgccatgtatggccgggcgcggtggctcacgcctgtaatcccagcgctttgggaggccaaggtgggcggatcacgaggtcaggagttccagaccagcagcctggccaacatagtgaaacctggtaacatagtgaaacctcgtctctactaaaaatgcaaaaaattagccaggcgtggtggcaggcgcctgcagtcctagctacttgggaggctgaggcaagagaatcgcttcaaccttggaggggggaggaggtgttgtcagccgagatcgcgccactgcatcccagcctgggcaacaagagtgaaactccgtctcaaaaaaatgaaataaaataaacgaatgatc

SEQ ID NO: 7006 - DNA, 2685 bp, Homo sapiens
acagtagcccggcggcccagggcaatccgaccacatttcactctcaccgctgtaggaatccagatgcaggccaagtacagcagcacgagggacatgctggatgatgatggggacaccaccatgagcctgcattctcaaggctctgccacaactcggcatccagagccccggcgcacagagcacagggctccctcttcaacgtggcgaccagtggccctgaccctgctgactttgtgcttggtgctgctgatagggctggcagccctggggcttttgttttttcagtactaccagctctccaatactggtcaagacaccatttctcaaatggaagaaagattaggaaatacgtcccaagagttgcaatctcttcaagtccagaatataaagcttgcaggaagtctgcagcatgtggctgaaaaactctgtcgtgagctgtataacaaagctggagcacacaggtgcagcccttgtacagaacaatggaaatggcatggagacaattgctaccagttctataaagacagcaaaagttgggaggactgtaaatatttctgccttagtgaaaactctaccatgctgaagataaacaaacaagaagacctggaatttgccgcgtctcagagctactctgagtttttctactcttattggacagggcttttgcgccctgacagtggcaaggcctggctgtggatggatggaacccctttcacttctgaactgttccatattataatagatgtcaccagcccaagaagcagagactgtgtggccatccttaatgggatgatcttctcaaaggactgcaaagaattgaagcgttgtgtctgtgagagaagggcaggaatggtgaagccagagagcctccatgtcccccctgaaacattaggcgaaggtgactgattcgccctctgcaactacaaatagcagagtgagccaggcggtgccaaagcaagggctagttgagacattgggaaatggaacataatcaggaaagactatctctctgactagtacaaaatgggttctcgtgtttcctgttcaggatcaccagcatttctgagcttgggtttatgcacgtatttaacagtcacaagaagtcttatttacatgccaccaaccaacctcagaaacccataatgtcatctgccttcttggcttagagataacttttagctctctttcttctcaatgtctaatatcacctccctgttttcatgtcttccttacacttggtggaataagaaactttttgaagtagaggaaatacattgaggtaacatccttttctctgacagtcaagtagtccatcagaaattggcagtcacttcccagattgtaccagcaaatacacaaggaattctttttgtttgtttcagttcatactagtcccttcccaatccatcagtaaagaccccatctgccttgtccatgccgtttcccaacagggatgtcacttgatatgagaatctcaaatctcaatgccttataagcattccttcctgtgtccattaagactctgataattgtctcccctccataggaatttctcccaggaaagaaatatatccccatctccgtttcatatcagaactaccgtccccgatattcccttcagagagattaaagaccagaaaaaagtgagcctcttcatctgcacctgtaatagtttcagttcctattttcttccattgacccatatttatacctttcaggtactgaagatttaataataataaatgtaaatactgtgaagtgtgtgtgattttacaatggacttatggttggtgggaaaattcagcatggaaatgcttttcaaaatatgatagcggtcattattttgattgtgccttactgaaagtttttggggaatttacaagagtactgattacatgattatctggagaaaataagatgtctttgaaatacgtgttggcttcaagaaaacagttttaacgttttcctaaaatgaaatcttttgaggtgagcttatggcatcaacacatggttgatgaggaagctgagttgcattagtgcacatgatttccagtcaggtcatgggaaatgaacagagacagtgacatctttgtagctgctcctttgtgaggcacttctttcttgagacgactccatgcacaaatataacagggatcattgggaatgacaccatcacagccaccaagtttattggtttactgataaatcaattttgagggttttatgctagaaaagataacattataaatctttgtttttcaacagtggaaactgaggtgcttcagttttgtttttcataaacatctatctcatggtaaaatgacgtatagtagcaatcatatgatagaaagaacacattggtgctcattttcataaacttcattttgttagattgtcacttagcaaagactattgcggattcttccttgagaactttcctttcaattttctgttgatttccttaaaattttcttcagggtcgagcaagttctgttgatatattgtgtcatgcaaagaaaactgtatttgtggttagaaaatgaagattttagacctcttattctgatttacttattaggcaagtcactttacttcatgaaacctatttcactgcatatgaagtagaaataattataatttcctcataatgttactgttagctgaaataaagtaaatgtgaaatca

SEQ ID NO: 7007 - DNA, 562 bp, Homo sapiens
aaagcgccttgggctcggctgtgctccagctcgcgctgctgaggtctggcctccgccagctgacttcaactgcaactgcaactcctcctcctcagccgccgcctcagggaacccaccgacccacaaaccagctcccgcaggggcggtgccgctgcctccttttcgttttctgtttttgtttttgttgtgttttttgtttttgttttgttttgtttttggagatgggatctcgctctgttgtccaggctggagtgcagtgacacaatctcagctcactgctgcctccgcctcccaggttcaagcgattctcctgcctcagcctcctgagtagctgggattacaggaatccagatgcaggccaagtacagcagcacgagggacatgctggatgatgatggggacaccaccatgagcctgcattctcaaggctctgccacaactcggcatccagagccccggcgcacagagcacagggctccctcttcaacgtggcgaccagtggccctgaccctgctgactttgtgcttggtgctgctgatagggctggcagccctggggcttt

SEQ ID NO: 7008 - DNA, 1442 bp, Homo sapiens
atggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatggtgaggaagcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagt

SEQ ID NO: 7009 - DNA, 1770 bp, Homo sapiens
ggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcaggggtatctgagctccaggaacacactacgcagaaggcacacctaggccactgtccccactgcccatctgtgtgtgtcccagttcattctgaaatgctcctgcgagtccagcagctggtgcaagacctgaagaaactgacctgccaggtggctactctcaacaacaatgcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaatcatacactctcgtgtatatacttcatataagtgaatatatactctcgtgagaactt

SEQ ID NO: 7010 - DNA, 1698 bp, Homo sapiens
ggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctctgctctgggccctgccatctcctgctgtccctgggcctcggcctcctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatggtgaggaagcctccactgaagggacctgctgccctgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaatcatacactctcgtgtatatacttcatataagtgaatatatactctcgtgagaactt

SEQ ID NO: 7011 - DNA, 1549 bp, Homo sapiens
tttgcagacatatgggtgattggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatgaggcatcaatcaaatacatttaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaa

SEQ ID NO: 7012 - DNA, 699 bp, Homo sapiens
atgtctgaagaagttacttatgcagatcttcaattccagaactccagtgagatggaaaaaatcccagaaattggcaaatttggggaaaaagttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatga

SEQ ID NO: 7013 - DNA, 1428 bp, Homo sapiens
ggaagaacagcctttcaaatttgacttctgcatgtggatagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgggttataagaaacgcacctgacttaaataacatgtattgtggatatataaatagactatatgttcaatattatcactgcacttataaaaaaagaatgatatgtgagaagatggccaatccagtgcagcttggttctacatattttagggaggcatgaggcatcaatcaaatacatttaaggagtgtagggggtgggggttctaggctataggtaaatttaaatattttctggttgacaattagttgagtttgtctgaagacctgggattttatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggcaa

SEQ ID NO: 7014 - DNA, 261 bp, Homo sapiens
cacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatatattttcagttatcaaaaagaaaactgaaaaattcttttggctgggattatcatgggactcctctggcagaagttggttctgggaagatggctctgttccctctccatccttgtac

SEQ ID NO: 7015 - DNA, 570 bp, Homo sapiens
tttgcagacatatgggtgattggtacagtaggtttataaacagaagtttaaacttatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaat

SEQ ID NO: 7016 - DNA, 1515 bp, Homo sapiens
tggtacagtaggtttataaacagaagtttaaacttgtaagcttaagcttccgtttataaacagaagtttaaaattataggtcctgtttaacattcagctctgttaactcactcatctttttgtgtttttacactttgtcaagatttctttacatattcatcaatgtctgaagaagttacttatgcagatcttcaattccagaactccagtgagatggaaaaaatcccagaaattggcaaatttggggaaaaagcacctccagctccctctcatgtatggcgtccagcagccttgtttctgactcttctgtgccttctgttgctcattggattgggagtcttggcaagcatgtttcacgtaactttgaagatagaaatgaaaaaaatgaacaaactacaaaacatcagtgaagagctccagagaaatatttctctacaactgatgagtaacatgaatatctccaacaagatcaggaacctctccaccacactgcaaacaatagccaccaaattatgtcgtgagctatatagcaaagaacaagagcacaaatgtaagccttgtccaaggagatggatttggcataaggacagctgttatttcctaagtgatgatgtccaaacatggcaggagagtaaaatggcctgtgctgctcagaatgccagcctgttgaagataaacaacaaaaatgcattggaatttataaaatcccagagtagatcatatgactattggctgggattatctcctgaagaagattccactcgtggtatgagagtggataatataatcaactcctctgcctgaaaatatcaaacgaagaaagaaaccagagtctcaacctgctggacactattggaagtccatcatttaacacgtttttagtatatacttttagcaggagacagctctgagtcaactgtgttgaggtgccaccacagcgagtttaggcactcagatccctgcatactcatcacattgggccataatggcaaatagaattttttgttttgttttgtttgtttgctttttctttcacatagaaatagtaagtgtaggagtgtgggtcagaaagaaaaggtggccctacctctgatggttggcaatgataggatacaatgggagataagctatctacaaatggagtggagaaggatatatatttcaaaggcctaatttgtagtgaaagactagagacaaaggtaatgtgtgtgtcaggagagagtacagatggaatcttgttttgcaaacgtagaatatgtatgtgtttgtaattattgcaaatggaatggtaatctataatggaatggaaaacattgtagatattttcagttatcaaaaagaaaactgaaaaagtatataataattgtatgtatgatatatatatgtgtgtgtgtgtgtatatatatcttcactttataactctgtgttgttttggggtttgtttctgaaagggggttgtaataaatgacatctgtactatgtcaccacaaataaatctcattcttaaacatttaa

SEQ ID NO: 7017 - DNA, 4203 bp, Homo sapiens
ttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagtcaggagtggcaggaaaggacgccgacgagtgttcagcctgtcggaggccgacagtcatggcggccactgggtttagtgctccgaacggcagctgccacggcacctcacgcacagtcaattcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaag

SEQ ID NO: 7018 - DNA, 2922 bp, Homo sapiens
cggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggtgagccagccccccgccctgcgccacagctcgttcatcatggtgggcgttcaaggtctttctctctgtggagcctgtgtgagctgcccttcctctctcagaagccccgtcggctggcagcaccagcttcttagaatttgtcaaagcacagcgcaagattaaacacagcccccaaaataaattttggctttcccttta

SEQ ID NO: 7019 - DNA, 6891 bp, Homo sapiens
aactgcatttcccagcgccccacgcggcggcggccgtaaagcgcggcggtcgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtgtcattggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaccaagaa

SEQ ID NO: 7020 - DNA, 6891 bp, Homo sapiens
aactgcatttcccagcgccccacgcggcggcggccgtaaagcgcggcggtcgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtctcagtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaccaagaa

SEQ ID NO: 7021 - DNA, 288 bp, Homo sapiens
atgcatgacagtaacaatgtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 7022 - DNA, 916 bp, Homo sapiens
tgaaaagctttctagtcctctcctactgatctccatcggttagcgccttgccatgattaatccagagctgcgggatggcagagctgatggcttcatacatcggatagttcccaagttgatacaaaactggaagattggccttatgtgcttcctgagtattattattactacagtttgcattattatgatagccacatggtccaagcatgctaaacctgtggcatgttcaggggactggcttggagtgagagataagtgtttctatttttctgatgataccagaaattggacagccagtaaaatattttgtagtttgcagaaagcagaacttgctcagattgatacacaagaagacatggaatttttgaagaggtacgcaggaactgatatgcactggattggactaagcaggaaacaaggagattcttggaaatggacaaatggcaccacattcaatggttggtttgaaattatagggaacggatcctttgctttcttgagtgctgatggagtccatagttccagaggatttattgatatcaagtggatttgcagcaaacctaaatattttttatagagcagaaaaaacttgaaaatgattatcacacttcaagattgaaagaagagctaattatgcaaaagtggctttctcacttattctgttacagaatacggaacctctggtgagggcccattttctagtttatagatggaaacttcttgctgtgccctgccatggttaaagagacaaggccgttctctggagccttttataagggcacaatcacatttactatggctccatcctcatgaactaatcacctcctgatggatggctccatcccctaataccatcacactggtgattagctttcaatttatgagttttgggaggacccaaatactcagaacatag

SEQ ID NO: 7023 - DNA, 1700 bp, Homo sapiens
ttttcctcttcaagtttctctctcagaacaaatgcagtgttaatcccgaagccgcttgcgggacactggcttcttctcctcagtttcctccctaatatatttgttgaggggtaatacaaaatcactgggaaactgattagagcagatttgaagacaaaattgtggcctggtaacttagcaaaagcataatggtgtcatcttgtatgctgatgataacgttctgggcactttgttactttcgttttcttttttccctctgtgtgtctttgtgtgtgtttgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagtttttttctttctttctttctctctctctctttctttctttctttctttctttctttttttaactgtaaaccagaaaacaattgtggggatcaaggacagacatagcacttagacaggactttcatgaccc

SEQ ID NO: 7024 - DNA, 465 bp, Homo sapiens
atgcatgacagtaacaatgtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctag

SEQ ID NO: 7025 - DNA, 935 bp, Homo sapiens
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 7026 - DNA, 859 bp, Homo sapiens
actcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcata

SEQ ID NO: 7027 - DNA, 399 bp, Homo sapiens
atgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatga

SEQ ID NO: 7028 - DNA, 1669 bp, Homo sapiens
aaaagctgtggtccccaggagtcctgaacatctggggacagcgggaaaacatgagtgactccaaggaaccaagggtgcagcagctgggcctcctggggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7029 - DNA, 1281 bp, Homo sapiens
ctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatctgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctc

SEQ ID NO: 7030 - DNA, 841 bp, Homo sapiens
aagaaagcagaagctctcttcccattatgacttcggaaatcacttatgctgaagtgaggttcaaaaatgaattcaagtcctcaggcatcaacacagcctcttctgcagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgt

SEQ ID NO: 7031 - DNA, 615 bp, Homo sapiens
atgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcaagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatga

SEQ ID NO: 7032 - DNA, 597 bp, Homo sapiens
atgacttcggaaatcacttatgctgaagtgaggttcaaaaatgaattcaagtcctcaggcatcaacacagcctcttctgcagttttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatga

SEQ ID NO: 7033 - DNA, 1126 bp, Homo sapiens
ttgctttctgtgctgtgcaagctttgttctttcgctgtttgggtccacggttcttttatgagctgtgataccgcggaagtctgtagcttcactcctgaagctagcaagaccacaagctcgccgagagaaacgagtaactctagacgtgccatcttaaaagctgtaacaccgcgaggcagatcctgcctcccacagtcaccctgctcccaagtgcaacctctgtctgaccctgcatggtgtgcggtgccctcctgcctcaggcctaggcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacacattcatttattcatttattcatt

SEQ ID NO: 7034 - DNA, 970 bp, Homo sapiens
actgcagagtctcctaagtcacatctcttcctttgcaagagtaggcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagagaaaggactctggtggttccagttgaaggtctggtccatggcagtcgtatccatcttgctcctcagtgtctgtttcactgtgagttctgtggtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattc

SEQ ID NO: 7035 - DNA, 1221 bp, Homo sapiens
cagtgattctcgtgcctcagcctcctgagtagccgaaattacagacgtgtgccaccatgcttggctaattttttggatttttagtagagatggggtttcactatgttggccaggctagtcttgaactcctggcctgaagcaatccgcccacctcagcctcccaaagtgctgagattataggcacgagccactacacctggccacaaaattctttaaagaagccaatcccatcctccctcaagagccaaggggccacctcaccctcttgttacagcagatcctgcctcccacagtcaccctgctcccaagtgcaacctctgtctgaccctgcatggtgtgcggtgccctcctgcctcaggccgcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacacattcatttattcatttattcatt

SEQ ID NO: 7036 - DNA, 1314 bp, Homo sapiens
cagtgattctcgtgcctcagcctcctgagtagccgaaattacagacgtgtgccaccatgcttggctaattttttggatttttagtagagatggggtttcactatgttggccaggctagtcttgaactcctggcctgaagcaatccgcccacctcagcctcccaaagtgctgagattataggcacgagccactacacctggccacaaaattctttaaagaagccaatcccatcctccctcaagagccaaggggccacctcaccctcttgttacagcagatcctgcctcccacagtcaccctgctcccaagtgcaacctctgtctgaccctgcatggtgtgcggtgccctcctgcctcaggccgcgaagaaggatctaagggcttggcttgtttgaaagaaccacaccccgaaagtaacatctttggagaaagtgatacaagagcttctgcacccacctgatagaggaagtccaaagggtgtgcgcacacacaatggtgcctgaagaagagcctcaagaccgagagaaaggactctggtggttccagttgaaggtctggtccatggcagtcgtatccatcttgctcctcagtgtctgtttcactgtgagttctgtggtgcctcacaattttatgtatagcaaaactgtcaagaggctgtccaagttacgagagtatcaacagtatcatccaagcctgacctgcgtcatggaaggaaaggacatagaagattggagctgctgcccaaccccttggacttcatttcagtctagttgctactttatttctactgggatgcaatcttggactaagagtcaaaagaactgttctgtgatgggggctgatctggtggtgatcaacaccagggaagaacaggatttcatcattcagaatctgaaaagaaattcttcttattttctggggctgtcagatccagggggtcggcgacattggcaatgggttgaccagacaccatacaatgaaaatgtcacattctggcactcaggtgaacccaataaccttgatgagcgttgtgcgataataaatttccgttcttcagaagaatggggctggaatgacattcactgtcatgtacctcagaagtcaatttgcaagatgaagaagatctacatataaatgaaatattctccctggaaatgtgtttgggttggcatccaccgttgtagaaagctaaattgattttttaatttatgtgtaagttttgtacaaggaatgcccctaaaatgtttcagcaggctgtcacctattacacttatgatataatccattcacacattcatttattcatttattcatt

SEQ ID NO: 7037 - DNA, 1936 bp, Homo sapiens
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtggaccagacgccatttaacccacgcagagtattctggcataagaatgaacccgacaactctcagggagaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacattaattgcaaagggcagtcacatccaactttaataaaatatggtggtctttcttaaaa

SEQ ID NO: 7038 - DNA, 583 bp, Homo sapiens
gcctggcaaggtttagcggaggcctgcagtctgtctgctcctcagcaccatgaattcgactccatgcagctctccataaatatactctgggggaaaaaaaatagaacaaattcttgccgtcctgaccattgaacaagagactaattagacaatggggctagaaaaacctcaaagtaaactggaaggaggcatgcatccccagctgataccttcggttattgctgtagttttcatcttacttctcagtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttgga

SEQ ID NO: 7039 - DNA, 2159 bp, Homo sapiens
aatattctacatctatcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcactaccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtctccagttctaccgatgttcccacaaaagacataatcttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 7040 - DNA, 1868 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtggtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7041 - DNA, 1934 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7042 - DNA, 1781 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7043 - DNA, 1821 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7044 - DNA, 1766 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7045 - DNA, 1733 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtggaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7046 - DNA, 1898 bp, Homo sapiens
acccagcttcctgtttgtcttcctgagagacagtagatttagaaagtgaggatcagagggtggaaaataaaagctgtggtccccaggagtcctgaacatctggggacagcgggaaaacatgagtgactccaaggaaccaagggtgcagcagctgggcctcctggaagaagatccaacaaccaactttcaattccagcagatacatggccacaagagctctacagggtgtcttggccatggcgccctggtgctgcaactcctctccttcatgctcttggctggggtcctgccaagattgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgc

SEQ ID NO: 7047 - DNA, 3511 bp, Homo sapiens
caggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccaggcacagcctactgaccccaaggagcctggcactgattggcatcacattgatctagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggagtaccctggctgttctccacactcacaagacatcagctatatactctgcttggtgcataagaaagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattggaagagttcctggatccttgcaagcttagataaatgtgatctttattagatagcagtggcatgctttaaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaattattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactctt

SEQ ID NO: 7048 - DNA, 1682 bp, Homo sapiens
agttgtaattgtgacttcttcttttgaggtacacttaatgttggaagtctcttagtcctataagagtgtgtagcagtttgtccctgagctctagcttctttaaatgaagctgagtctctgggcaacatctttagggagagaggtacaaaaggttcctggaccttctcaacacagggagcctgcataatgatgcaagagcagcaacctcaaagtacagagaaaagaggctggttgtccctgagactctggtctgtggctgggatttccattgcactcctcagtgcttgcttcattgtgagctgtgtagtaacttaccattttacatatggtgaaactggcaaaaggctgtctgaactacactcatatcattcaagtctcacctgcttcagtgaagggacaaaggtgccagcctggggatgttgcccagcttcttggaagtcatttggttccagttgctacttcatttccagtgaagagaaggtttggtctaagagtgagcagaactgtgttgagatgggagcacatttggttgtgttcaacacagaagcagagcagaatttcattgtccagcagctgaatgagtcattttcttattttctggggctttcagacccacaaggtaataataattggcaatggattgataagacaccttatgagaaaaatgtcagattttggcacctaggtgagcccaatcattctgcagagcaatgtgcttcaatagtcttctggaaacctacaggatggggctggaatgatgttatctgtgaaactagaaggaattcaatatgtgagatgaataagatttacctatgagtagaagcttaattggaaagaagagaagaattactgacgtaattttttccctgacgtctttaaaattgaaccctatcatgaaatgataatttcttcctgaatttacacataatccttatgttatagaggttcacagaaatggaaagatacctgtttccctttaatcaatcttctcgtttcctcttttccattaatgatagaatgcacccttcctctctttgttccattctttcacttgttattcatttttttctttcttcacacttcattacacaaatatttattgtttcagagactgtactattttgtttgttagaagatttataaggcagtatcttttgaaaattatgactttccttcctcaatataccataaagaaatctttttggtcaagatggtagttggaactacaatcatctgaaggcctgacaagagttgaaagacatgttttctagatggctcactcacatggctggcaacttggtgttggctattaatgtaacctggaaataaattttattctgcagttagggatttggcattttatatatgttgattcaatcaagtttggcaagcagggtgttcgatactgctatatcctgtattcttggtttatttgttttatttctgagaaatatgtgttaagatctctcgctgattgggaatttgtctatttctcatttaaattttgtcaaatctttctttgcttgcaagcatttcttgttacccaaatctaatctattcctgaaaatatgatggttagcaaagtttgagataactagagcctgtaatccatcattttaaatggcaatgataatgacagtttatttttatgttatataaaaacctcaacaaattttccaaac

SEQ ID NO: 7049 - DNA, 1154 bp, Homo sapiens
agacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataag

SEQ ID NO: 7050 - DNA, 1130 bp, Homo sapiens
ggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatc

SEQ ID NO: 7051 - DNA, 425 bp, Homo sapiens
ccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctggtttcaaagctgtggaattcaaaggataaattaatgaagaaaacaagcggagctgaagaagaaagtacaatatggtgctgtcttcctaatgaaataaattcactaaatggaca

SEQ ID NO: 7052 - DNA, 2446 bp, Homo sapiens
atctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 7053 - DNA, 1000 bp, Homo sapiens
atgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgcca

SEQ ID NO: 7054 - DNA, 881 bp, Homo sapiens
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggtactgggcagtttctcaaggatctctcatttttaaataacagaagaaagctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgagtctcactctgttgcccaagctagagtgcagtgaagccgcgacatcccaggctcaagtgatcctcccacctcagcttcctgagtagggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 7055 - DNA, 1592 bp, Homo sapiens
atttcctgctcttgaatatctggttgaactacttaagcttaatttgttaaactccggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaa

SEQ ID NO: 7056 - DNA, 625 bp, Homo sapiens
atggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgatttcagatcagaaccacagctacccaagaaaacccatctccaaattgtgtatggattcacgtgtcagtcatttatgaccaactgtgtagtgtgccctcatatagtatttgtgagaagaagttttcaatgtaa

SEQ ID NO: 7057 - DNA, 10767 bp, Homo sapiens
gttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctgactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcaggatccaagtgatcagttttgccacggagcagaactgggacttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 7058 - DNA, 10938 bp, Homo sapiens
ccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 7059 - DNA, 11740 bp, Homo sapiens
gactgcgccgtgcccagcctcggtcccctctctgtgggtaaggatggttgagtccagcctccacggcagcggctccttgtgccactagcagcccttcttctgcgctctccgccttttctctctagactggatctctcctcccccccgcgcccccctccccgcatctcccactcgctggctctctctccagctgcctcctctccaggtctctcctggctgcgcgcgctcctctccccgcttctccccctcccgcagcctcgccgccttggtgccttcctgcccggctcggccggcgctcgtccccggccccggccccgccagcccgggtctccgcgctcggagcagctcagccctgcagtggctcgggacccgatgctatgagagggaagcgagccgggcgcccagaccttcaggaggcgtcggatgcgcggcgggtcttgggaccgggctctctctccggctcgccttgccctcgggtgattatttggctccgctcatagccctgccttcctcggaggagccatcggtgtcgcgtgcgtgtggagtatctgcagacatgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagtagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatagccctcagtgccccaacaggactgattcatagccatacctctgatggacaagcagtgattcctttggtgccatataccactctcccttccactctggctttactgcagcgatcttcaaccttgtctactggcataagtgcagcggggatctctactcaaatgtgtcagggtcttctacggatcaaactacacatgcgttttcattccaaaagtgggttctaaatgcctggctgcatctgtatgaaatcaaggcacactccaggaagactgccacgtcgcgccaacacgtcatactcaatgcctcagactttcatatttctgtgttgctgagatgcctttcaatgcaatcgtctgggctcgtggatatgtccctcaggtgcggtgacagaatggtggcaccacgatatgtgttctcttgtgttgtttttcctttttaaacccccatgaacacgaatactctgaaaaaaataaaaagctttctggaaga

SEQ ID NO: 7060 - DNA, 10695 bp, Homo sapiens
atgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagttatctcgtgtggaagcctttcctttcccccaaatggcaacaagattggaacgttgacagtttatggggccacagctatatttacgtgcaacaccggctacacgcttgtggggtctcatgtcagagagtgcttggcaaatgggctctggagcggcagcgaaactcgatgtctggctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgtcctgtggcaaccctggcacacccaccaacggaatgattgtcagtagtgatggcattctgttctccagctcggtcatctatgcctgctgggaaggctacaagacctcagggctcatgacacggcattgcacagccaatgggacctggacaggcactgctcccgactgcacaattataagttgtggggatccaggcacactagcaaatggcatccagtttgggaccgacttcaccttcaacaagactgtgagctatcagtgtaacccaggctatgtcatggaagcagtcacatccgccactattcgctgtaccaaagacggcaggtggaatccgagcaaacctgtctgcaaagccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 7061 - DNA, 6330 bp, Homo sapiens
atgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaaggaggatctggaaacattggtcctgctttcccatgtcttgacaccccattccaagccagatgtcaaggagaagaaaggactttcaattaa

SEQ ID NO: 7062 - DNA, 10164 bp, Homo sapiens
atgactgcgtggaggagattccagtcgctgctcctgcttctcgggctgctggtgctgtgcgcgaggctcctcactgcagcgaagggtcagaactgtggaggcttagtccagggtcccaatggcactattgagagcccagggtttcctcacgggtatccgaactatgccaactgcacctggatcatcatcacgggcgagcgcaataggatacagttgtccttccatacctttgctcttgaagaagattttgatattttatcagtttacgatggacagcctcaacaagggaatttaaaagtgagattatcgggatttcagctgccctcctctatagtgagtacaggatctatcctcactctgtggttcacgacagacttcgctgtgagtgcccaaggtttcaaagcattatatgaagttttacctagccacacttgtggaaatcctggagaaatcctgaaaggagttctgcatggaacgagattcaacataggagacaaaatccggtacagctgcctccctggctacatcttggaaggccacgccatcctgacctgcatcgtcagcccaggaaatggtgcatcgtgggacttcccagctcccttttgcagagctgagggagcctgcggaggaaccttacgcgggaccagcagctccatctccagcccgcacttcccttcagagtacgagaacaacgcggactgcacctggaccattctggctgagcccggggacaccattgcgctggtcttcactgactttcagctagaagaaggatatgatttcttagagatcagtggcacggaagctccatccatatggctaactggcatgaacctcccctctccagttatcagtagcaagaattggctacgactccatttcacctctgacagcaaccaccgacgcaaaggatttaacgctcagttccaagtgaaaaaggcgattgagttgaagtcaagaggagtcaagatgctgcccagcaaggatggaagccataaaaactctgtcttgagccaaggaggtgttgcattggtctctgacatgtgtccagatcctgggattccagaaaatggtagaagagcaggttccgacttcagggttggtgcaaatgtacagttttcatgtgaggacaattacgtgctccagggatctaaaagcatcacctgtcagagagttacagagacgctcgctgcttggagtgaccacaggcccatctgccgagcgagaacatgtggatccaatctgcgtgggcccagcggcgtcattacctcccctaattatccggttcagtatgaagataatgcacactgtgtgtgggtcatcaccaccaccgacccggacaaggtcatcaagcttgcctttgaagagtttgagctggagcgaggctatgacaccctgacggttggtgatgctgggaaggtgggagacaccagatcggtcttgtacgtgctcacgggatccagtgttcctgacctcattgtgagcatgagcaaccagatgtggctacatctgcagtcggatgatagcattggctcacctgggtttaaagctgtttaccaagaaattgaaaagggagggtgtggggatcctggaatccccgcctatgggaagcggacgggcagcagtttcctccatggagatacactcacctttgaatgcccggcggcctttgagctggtgggggagagagttatcacctgtcagcagaacaatcagtggtctggcaacaagcccagctgtgtattttcatgtttcttcaactttacggcatcatctgggattattctgtcaccaaattatccagaggaatatgggaacaacatgaactgtgtctggttgattatctcggagccaggaagtcgaattcacctaatctttaatgattttgatgttgagcctcagtttgactttctcgcggtcaaggatgatggcatttctgacataactgtcctgggtactttttctggcaatgaagtgccttcccagctggccagcagtgggcatatagttcgcttggaatttcagtctgaccattccactactggcagagggttcaacatcacttacaccacatttggtcagaatgagtgccatgatcctggcattcctataaacggacgacgttttggtgacaggtttctactcgggagctcggtttctttccactgtgatgatggctttgtcaagacccagggatccgagtccattacctgcatactgcaagacgggaacgtggtctggagctccaccgtgccccgctgtgaagctccatgtggtggacatctgacagcgtccagcggagtcattttgcctcctggatggccaggatattataaggattctttacattgtgaatggataattgaagcaaaaccaggccactctatcaaaataacttttgacagatttcagacagaggtcaattatgacaccttggaggtcagagatgggccagccagttcgtccccactgatcggcgagtaccacggcacccaggcaccccagttcctcatcagcaccgggaacttcatgtacctgctgttcaccactgacaacagccgctccagcatcggcttcctcatccactatgagagtgtgacgcttgagtcggattcctgcctggacccgggcatccctgtgaacggccatcgccacggtggagactttggcatcaggtccacagtgactttcagctgtgacccggggtacacactaagtgacgacgagcccctcgtctgtgagaggaaccaccagtggaaccacgccttgcccagctgcgacgctctatgtggaggctacatccaagggaagagtggaacagtcctttctcctgggtttccagatttttatccaaactctctaaactgcacgtggaccattgaagtgtctcatgggaaaggagttcaaatgatctttcacacctttcatcttgagagttcccacgactatttactgatcacagaggatggaagtttttccgagcccgttgccaggctcaccgggtcggtgttgcctcatacgatcaaggcaggcctgtttggaaacttcactgcccagcttcggtttatatcagacttctcaatttcgtacgagggcttcaatatcacattttcagaatatgacctggagccatgtgatgatcctggagtccctgccttcagccgaagaattggttttcactttggtgtgggagactctctgacgttttcctgcttcctgggatatcgtttagaaggtgccaccaagcttacctgcctgggtgggggccgccgtgtgtggagtgcacctctgccaaggtgtgtggccgaatgtggagcaagtgtcaaaggaaatgaaggaacattactgtctccaaattttccatccaattatgataataaccatgagtgtatctataaaatagaaacagaagccggcaagggcatccaccttagaacacgaagcttccagctgtttgaaggagatactctaaaggtatatgatggaaaagacagttcctcacgtccactgggcacgttcactaaaaatgaacttctggggctgatcctaaacagcacatccaatcacctgtggctagagttcaacaccaatggatctgacaccgaccaaggttttcaactcacctataccagttttgatctggtaaaatgtgaggatccgggcatccctaactacggctataggatccgtgatgaaggccactttaccgacactgtagttctgtacagttgcaacccggggtacgccatgcatggcagcaacaccctgacctgtttgagtggagacaggagagtgtgggacaaaccactaccttcgtgcatagcggaatgtggtggtcagatccatgcagccacatcaggacgaatattgtcccctggctatccagctccgtatgacaacaacctccactgcacctggattatagaggcagacccaggaaagaccattagcctccatttcattgttttcgacacggagatggctcacgacatcctcaaggtctgggacgggccggtggacagtgacatcctgctgaaggagtggagtggctccgcccttccggaggacatccacagcaccttcaactcactcaccctgcagttcgacagcgacttcttcatcagcaagtctggcttctccatccagttctccacctcaattgcagccacctgtaacgatccaggtatgccccaaaatggcacccgctatggagacagcagagaggctggagacaccgtcacattccagtgtgaccctggctatcagctccaaggacaagccaaaatcacctgtgtgcagctgaataaccggttcttttggcaaccagaccctcctacatgcatagctgcttgtggagggaatctgacgggcccagcaggtgttattttgtcacccaactacccacagccgtatcctcctgggaaggaatgtgactggagagtaaaagtgaacccggactttgtcatcgccttgatattcaaaagtttcaacatggagcccagctatgacttcctacacatctatgaaggggaagattccaacagccccctcattgggagttaccagggctctcaggccccagaaagaatagagagtagcggaaacagcctgtttctggcatttcggagtgatgcctccgtgggcctttcagggttcgccattgaatttaaagagaaaccacgggaagcttgttttgacccaggaaatataatgaatgggacaagagttggaacagacttcaagcttggctccaccatcacctaccagtgtgactctggctataagattcttgacccctcatccatcacctgtgtgattggggctgatgggaaaccctcctgggaccaagtgctgccctcctgcaatgctccctgtggaggccagtacacgggatcagaaggggtagttttatcaccaaactacccccataattacacagctggtcaaatatgcctctattccatcacggtaccaaaggaattcgtggtctttggacagtttgcctatttccagacagccctgaatgatttggcagaattatttgatggaacccatgcacaggccagacttctcagctcactctcggggtctcactcaggggaaacattgcccttggctacgtcaaatcaaattctgctccgattcagtgcaaagagcggtgcctctgcccgcggcttccacttcgtgtatcaagctgttcctcgtaccagtgacacccaatgcagctctgtccccgagcccagatacggaaggagaattggttctgagttttctgccggctccatcgtccgattcgagtgcaacccgggatacctgcttcagggttccacggcgctccactgccagtccgtgcccaacgccttggcacagtggaacgacacgatccccagctgtgtggtaccctgcagtggcaatttcactcaacgaagaggtacaatcctgtcccccggctaccctgagccatacggaaacaacttgaactgtatatggaagatcatagttacggagggctcgggaattcagatccaagtgatcagttttgccacggagcagaactgggactcccttgagatccacgatggtggggatgtgaccgcacccagactgggaagcttctcaggcaccacagtaccggcactgctgaacagtacttccaaccaactctacctgcatttccagtctgacattagtgtggcagctgctggtttccacctggaatacaaaactgtaggtcttgctgcatgccaagaaccagccctccccagcaacagcatcaaaatcggagatcggtacatggtgaacgacgtgctctccttccagtgcgagcccgggtacaccctgcagggccgttcccacatttcctgtatgccagggaccgttcgccgttggaactatccgtctcccctgtgcattgcaacctgtggagggacgctgagcaccttgggtggtgtgatcctgagccccggcttcccaggttcttaccccaacaacttagactgcacctggaggatctcattacccatcggctatggtgcacatattcagtttctgaatttttctaccgaagctaatcatgacttccttgaaattcaaaatggaccttaccacaccagccccatgattggacaatttagcggcacggatctccccgcggccctgctgagcacaacgcatgaaaccctcatccacttttatagtgaccattcgcaaaaccggcaaggatttaaacttgcttaccaagcctatgaattacagaactgtccagatccacccccatttcagaatgggtacatgatcaactcggattacagcgtggggcaatcagtatctttcgagtgttatcctgggtacattctaataggccatcctgtcctcacttgtcagcatgggatcaacagaaactggaactacccttttccaagatgtgatgccccttgtgggtacaacgtaacttctcagaacggcaccatctactcccctggctttcctgatgagtatccgatcctgaaggactgcatttggctcatcacggtgcctccagggcacggagtttacatcaacttcaccctgttacagacggaagctgtcaacgattacattgctgtttgggacggtcccgatcagaactcaccccagctgggagttttcagtggcaacacagccctcgaaacggcgtatagctccaccaaccaagtcctgctcaagttccacagcgacttttcaaatggaggcttctttgtcctcaatttccacgcatttcagctcaagaaatgtcaacctcccccagcggttccacaggcagaaatgcttactgaggatgatgatttcgaaataggagattttgtgaagtaccagtgccaccccgggtacaccttggtggggaccgacattctgacttgcaagctcagttcccagttgcagtttgagggttctctcccaacatgtgaagcacaatgcccagcaaatgaagtccggactggatcatcgggagtcattctcagtccagggtatccgggtaattattttaactcccagacttgctcttggagtattaaagtggaaccaaactacaacattaccatctttgtggacacatttcaaagtgaaaagcagtttgatgcactggaagtgtttgatggttcttctgggcaaagtcctctgctagtagtcttaagtgggaatcatactgaacaatcaaattttacaagcaggagtaatcagttatatctccgctggtccactgaccatgccaccagtaagaaaggattcaagattcgctatgcagcaccttactgcagtttgacccaccccctgaagaatgggggtattctaaacaggactgcaggagcggttggaagcaaagtgcattatttttgcaagcctggataccgaatggtcggccacagcaatgcaacctgtagacgaaacccacttggcatgtaccagtgggactccctcacgccactctgccaggctgtgtcctgtggaatcccagaatccccaggaaacggttcatttaccgggaacgagttcactttggacagtaaagtggtctatgaatgtcatgagggcttcaagcttgaatccagccagcaagcaacagccgtgtgtcaagaagatgggttgtggagtaacaaggggaagccgcccacgtgtaagccggtcgcttgccccagcattgaagctcagctctcagaacatgtcatctggaggctggtttcaggatccttgaatgagtacggtgctcaagtattgctgagctgcagtcctggttactacttagaaggctggaggctcctgcggtgccaggccaatgggacgtggaacataggagatgagaggccaagctgtcgagctggccactgcggttccccagacccgattgtgaacggtcacattagtggagatggcttcagttacagagacacggtggtttaccagtgcaatcctggtttccggcttgtgggaacttccgtgaggatatgcctgcaagaccacaagtggtctggacaaacgcctgtctgtgtccccatcacatgtggtcaccctggaaaccctgcccacggattcactaatggcagtgagttcaacctgaatgatgtcgtgaatttcacctgcaacacgggctatttgctgcagggcgtgtctcgagcccagtgtcggagcaacggccagtggagtagccctctgcccacgtgtcgagtggtgaactgttctgatccaggctttgtggaaaatgccattcgtcacgggcaacagaacttccctgagagttttgagtatggaatgagtatcctgtaccattgcaagaagggattttacttgctgggatcttcagccttgacctgtatggcaaatggcttatgggaccgatccctgcccaagtgtttggctatatcgtgtggacacccaggggtccctgccaacgccgtcctcactggagagctgtttacctatggcgccgtcgtgcactactcctgcagagggagcgagagcctcataggcaacgacacgagagtgtgccaggaagacagtcactggagcggggcactgccccactgcacaggaaataatcctggattctgtggtgatccggggaccccagcacatgggtctcggcttggtgatgactttaagacaaagagtcttctccgcttctcctgtgaaatggggcaccagctgaggggctcccctgaacgcacgtgtttgctcaatgggtcatggtcaggactgcagccggtgtgtgaggccgtgctgtgtcctcagccgccgccggtgcagaatggaacagtggagggaagtgatttccgctggggctccagcataagttacagctgcatggacggttaccagctctctcactccgccatcctctcctgtgaaggtcgcggggtgtggaaaggagagatcccccagtgtctccctgtgttctgcggagaccctggcatccccgcagaagggcgacttagtgggaaaagtttcacctataagtccgaagtcttcttccagtgcaaatctccatttatactcgtgggatcctccagaagagtctgccaagctgacggcacgtggagcggcatacaacccacctgcattgatcctgctcataacacctgcccagaccctggtacgccacactttggaatacagaatagctccagaggctatgaggttggaagcacggtttttttcaggtgcagaaaaggctaccatattcaaggttccacgactcgcacctgccttgccaatttaacatggagtgggatacagaccgaatgtatacctcatgcctgcagacagccagaaaccccggcacacgcggatgtgagagccatcgatcttcctactttcggctacaccttagtgtacacctgccatccaggctttttcctcgcagggggatctgagcacagaacatgtaaagcagacatgaaatggacaggaaagtcgcctgtgtgtaaaagtaaaggagtgagagaagttaatgaaacagttactaaaactccagttccttcagatgtctttttcgtcaattcactgtggaaggggtattatgaatatttagggaaaagacaacccgccactctaactgttgactggttcaatgcaacaagcagtaaggtgaatgccaccttcagcgaagcctcgccagtggagctgaagttgacaggcatttacaagaaggaggaggcccacttactcctgaaagcttttcaaattaaaggccaggcagatatttttgtaagcaagttcgaaaatgacaactggggactagatggttatgtgtcatctggacttgaaagaggaggatttacttttcaaggtgacattcatggaaaagactttggaaaatttaagctagaaaggcaagatcctttaaacccagatcaagactcttccagtcattaccacggcaccagcagtggctctgtggcggctgccattctggttcctttctttgctctaattttatcagggtttgcattttacctctacaaacacagaacgagaccaaaagttcaatacaatggctatgctgggcatgaaaacagcaatggacaagcatcgtttgaaaaccccatgtatgatacaaacttaaaacccacagaagccaaggctgtgaggtttgacacaactctgaacacagtctgtacagtggtatag

SEQ ID NO: 7063 - DNA, 13108 bp, Homo sapiens
tcctgggatggggtaggaggctattgtgaatgaggctcataagcatcgcccccggccctagatggcaagttcaaagccaccacccaagatcagctggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggatttgacttactcccaccagatttcttccttcctgagaggttttgatctctcggagttggaaagaaccaactcaactcctcccgtcgccgcttcctatgtctgggatcttgatcctggttgtgaagcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattg

SEQ ID NO: 7064 - DNA, 1544 bp, Homo sapiens
caactgatgaaaggaggaagaagaaagggacttggaacaagcaagaaaatgagcctaatggtggcccatgtgatcaaatttgcataaggacagaagacaagaccgaaggagctgatgggtagagaggagatattgctgtcaacagagtggaggtctcagtggggaaagatgaactctactggaggttcagaaaacaactgtgaaagaaatacttgaggcatgtttcaacagactgcaaatataccatctaattcttggaaacaagtacaagataaattgattctgaagctgagggctttgggcagcaaaatctgactttccggaagaggtgtaagatggtgctggtggagctttgtaaggattctctgcagggctagagttctgagtccacaggtcctctttgcaaagcccgcatgtgtgatgcccaccttcgaggcccctcgggcatcatcacctcccccaatttccccattcagtatgacaacaatgcacactgtgtgtggatcatcacagcactcaacccctccaaggcgggaggagacccagggaacatacaatgcaacaaggagggtctaagtgtggaaactcaaagtctaagactgaggaatagaagttgtcttctgggaaacagcaaggacaatggatgctgtgtgcctaaccctgttcatggaactggcctacaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgtgtaagtgagcagggaggaggccacgccagggtcttcactgagaggcaggggcccgtttcctagctaatccaggggccccgtccctgggaaccttgcaggttgtaacaacagctgcactctggttggtttattctactcctcggaacgttgctggtggggtccttatttctggcaggaatgtcgactgtagcactgagaacaagtgctcctgacatttggggatgctcttcaacaccgtcttacccttcttggtgatccttaagagcaaggagacaccactgggacaaagcccaccaggctcagacccagacatttcctgctcaccgtcattgccacccctgacaccatctaatccagcagggtggaagggactgtcaagtttgtaaggctgtagacaccaccagcctccagtaactgtgggaaactggccttgccaggatataaacagtttcctaaaattg

SEQ ID NO: 7065 - DNA, 3212 bp, Homo sapiens
caggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgatcactgcagatattttaaccagaaatcaggaaagctggattttactcccagctccaccttgggccagctgtgtaaaaccttgcacaggtcccttccccacttgagacttcagtttcttcacctgtagaattaccggcttggagtttgtgacctgtaagaattctgtgaggtagtaaggcaaatattctaacccccactttacaaatgaagaaatagggcaaaggaaggctcaagtacttgcccaaaaccatgtggatagaactggaaacagaacccagcctccgcagtatctgctgcagtatctgctacagtatctgctctggtgtgactatacagtgttattacatcatgcgtgcacttgcagaaacacactaagactgtgaaagaggtagtgaaagaaacaggaagcaacagagagaaacaaggatgtaaagaacctaagcagctgtgactgccattcccaggagctatcgtccagggtgagtgcaatgtgggaatgagactccgccctctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcacccttctgagcctcaatgttattatgcacaaaataggaatcatataagtacctaacctcctaaagttaaatgaaacaatgcttggaaatccttagctccaggcacagagtataaaaggtgatcaataaattatagttctaatagtcatcattgtcatgattatttttattatatctagatattgacaggcttggtgtaaagttaccttggtggtaggccaggtctcttgttcctgttcctgagccttcacctgtaccagaaccaggcaaaggaggctcagcacagccccaggccatccttatttccaagttcttctcagcaaggtctttcattgagagtgcttgcctaagggcacaatgctccttctgcctctcagatgagacacaaggcccttgctatggtgtaaatgcttaggcccccctagaattcatatgctgacatcctaacccccaaggtgatggtattaggaggtggggccttgggaggcaattaggtcagacaacagagccctcatgaatgggattagtgcctttataaaagagacccacagaatcaccacactgaagccttctcagtggaaagagctaagaagcacaggaaacacagaggccgaggtgggcggatcgcctgaggtgaggagttcaagaccagcctgaccaacatggagaaaccctgtctctactaaaaatacaaaattagatgggcgtggtggcgcatgcctgtaatcccagctactcaggaggctgaggcagaagaatcggttgaacctgggaggcggaggttgcagtgagccaagatcacgccattgcactccagcctgggcaacaagtgtgaaactccatctc

SEQ ID NO: 7066 - DNA, 4379 bp, Homo sapiens
gagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgggcacttggcagctgtttgtacattgtgacacccctccacgcacacatctgccccccagccacagaagcttggaccagaggtggacacctgagctgactgcagcaggggcaatcagatgttctctcttgggaagttgaaataggacccaagagattctacttttgcctggacccatctcctgaaaagataaaaatccaagtgcaatggattgctgctcttctactttccatgtggaccaaaaagtagaacaatcctatgtgcagaaagagaatgattgagaagtggaaaaatttccttggtttctgatggcccttcagttcctcgtcctctacctttgtgaagtctggctgcaaacccacccttgggttctctcttctctgagaggcttttttgcttattctagcctgaattgatttatttacatccaaaggttcccaaggaatacaacaacctaggacccagcaatcctacttctgggaattatgcaaagatatgtgcatgaagatattgcttgatatgttataacagggaaattagaaataatctaaatgtaaaaatagtaagagattaggtattataaatttaaagtgtatactcagagagagagagatagggaaagatacagtcattacaaatcattcatgtatgaacctgggcaacatagtgagactctgcctctacc

SEQ ID NO: 7067 - DNA, 13684 bp, Homo sapiens
gagagcgcagcgcgcctctccccggccgggcggacacttggttcattccagccgcagaagctcagggctcccgcgtaccgggattttttccgagcagaaaaaagctccagagctctcctgacctcctttctcctcggcggcgagcggagcctctccctcggcgctgccggccgcgccatgccgcgctcgcggggacgggagctggggcgctgcggctgccccgcggggagggctcgcggcgaaaccgggatttcggcgcttgtgccgggcgccgggagccgctggggccgcccgccgccgccaacgccgccgcctctgctgctgttgctgggctgtgggttgctcagcgtctcggccgccgcgggccagaactgcacgttccaactgcacggtcccaatgggacagttgagagcccagggttcccatatggctaccccaattacgccaactgcacgtggaccatcaccgcggaagagcagcacagaatccagcttgtgttccagtcctttgccctggaagaggactttgatgtcctgtcggtgtttgatggtccaccccagccagagaatctgcgtacgaggctcacaggctttcagctgccagccaccattgttagtgcagccaccaccctctctctgcgcctcatcagcgactatgcagtcagtgcccaaggcttccacgccacctatgaagttctccccagccacacatgtgggaacccagggaggctgcccaatggcatccagcagggttcaaccttcaacctcggtgacaaggtccgctacagctgcaaccttggcttcttcctggagggccacgccgtgctcacctgccacgctggctctgagaacagcgccacgtgggacttccccctgccttcctgcagagctgatgatgcctgtggtgggaccctgcggggccagagtggcatcatctccagcccccacttcccctcggagtaccataacaatgccgactgcacatggaccatcctggctgagctgggggacaccatcgccctggtgtttattgacttccagctggaggatggttacgactttctggaagtcactgggacagaaggctcctccctctggttcaccggagccagcctcccagcccccgttatcagcagcaagaactggctgcgactgcacttcacatcggatggcaaccaccggcagcgcggattcagtgcccaataccaagtcaagaagcaaattgagttgaagtctcgaggtgtgaagctgatgcccagcaaagacaacagccagaagacgtctgtgttaactcaggttggtgtgtcccaaggacataatatgtgtccagaccctggcatacccgaaaggggcaaaagactaggctcggatttcaggttaggatccagcgtccagttcacctgcaacgagggctatgacctgcaagggtccaagcggatcacctgtatgaaagtgagcgacatgtttgcggcctggagcgaccacaggccagtctgccgagcccgcatgtgtgatgcccaccttcgaggcccctcgggcatcatcacctcccccaatttccccattcagtatgacaacaatgcacactgtgtgtggatcatcacagcactcaacccctccaaggtgatcaagctcgcctttgaggagtttgatttggagaggggctatgacaccctgacggtcggtgatggtggtcaggatggggaccagaagacagttctctacatcctgacaggtacatcggtcccggatctcattgtcagcaccaatcatcaaatgtggctcctcttccagactgatggcagtggcagttccctgggattcaaggcttcttatgaagagatcgagcagggcagttgcggtgaccctggcatacctgcatatggccggagggaaggctcccggtttcaccacggtgacacactcaagtttgagtgccagcccgcctttgagctggtgggacagaaggcaatcacatgccaaaagaataaccaatggtcggctaagaagccaggctgcgtgttctcctgcttcttcaacttcaccagcccgtctggggttgtcctgtctcccaactacccagaggactatggcaaccacctccactgtgtctggctcatcctggccaggcctgagagccgcatccacctggccttcaacgacattgacgtggagcctcagtttgatttcctggtcatcaaggatggggccaccgccgaggcgcccgtcctgggcaccttctcaggaaaccagcttccctcctccatcacaagcagtggccacgtggcccgtctcgagttccagactgaccactccacagggaagaggggcttcaacatcacttttaccaccttccgacacaacgagtgcccggatcctggcgttccagtaaatggcaaacggtttggggacagcctccagctgggcagctccatctccttcctctgtgatgaaggcttccttgggactcagggctcagagaccatcacctgcgtcctgaaggagggcagcgtggtctggaacagcgctgtgctgcggtgtgaagctccctgtggtggtcacctgacttcgcccagcggcaccatcctctctccgggctggcctggcttctacaaggatgccttgagctgtgcctgggtgattgaggcccagccaggctaccccatcaaaatcaccttcgacagattcaaaaccgaggtcaactatgacaccctggaagtacgcgatgggcggacttactcagcgcccttgatcggggtttaccacgggacccaggttccccagttcctcatcagcaccagcaactacctctacctcctcttctctaccgacaagagtcactcggacatcggcttccagctccgctatgagactataacactgcagtcagaccactgtctggatccaggaatcccagtaaatggacagcgtcatgggaatgacttctacgtgggcgcgctggtgaccttcagctgtgactcgggctacacattaagtgacggggagcctctggagtgtgagcccaacttccagtggagccgggccctgcccagttgtgaagctctctgtggtggcttcattcaaggctccagtgggaccatcttgtcgccagggttccctgacttctaccccaacaacttgaactgcacctggattatcgaaacatctcatggcaagggtgtgttcttcactttccacaccttccacctggaaagtggccatgactacctcctcatcactgagaacggcagcttcacccagcccctgaggcagctaactggatctcggctgccagctcccatcagcgctgggctctatggcaacttcactgcccaggtccgcttcatctctgatttctccatgtcatatgaaggattcaacatcaccttctcagagtacgacttggagccctgtgaggagcccgaggtcccagcctacagcatccggaagggcttgcagtttggcgtgggcgacaccttgaccttctcctgcttccccgggtaccgtctggagggcaccgcccgcatcacgtgcctggggggcagacggcgcctgtggagctcgcctctgccaaggtgtgttgctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgcttatccactcaccaaatgccctcctcccaccatcctccccaacgccgaagtcgtcacagagaatgaagaattcaatataggtgacatcgtacgctacagatgcctccctggctttaccttagtggggaatgaaattctgacctgcaaacttggaacctacctgcagtttgaaggaccacccccgatatgtgaagtgcactgtccaacaaatgagcttctgacagactccacaggcgtgatcctgagccagagctaccctggaagctatccccagttccagacctgctcttggctggtgagagtggagcccgactataacatctccctcacagtggagtacttcctcagcgagaagcaatatgatgagtttgagatttttgatggtccatcaggacagagtcctctgctgaaagccctcagtgggaattactcagctcccctgattgtcaccagctcaagcaactctgtgtacctgcgttggtcatctgatcacgcctacaatcggaagggcttcaagatccgctattcagccccttactgcagcctgcccagggctccactccatggcttcatcctaggccagaccagcacccagcccgggggctccatccactttggctgcaacgccggctaccgcctggtgggacacagcatggccatctgtacccggcacccccagggctaccacctgtggagcgaagccatccctctctgtcaagctctttcctgtgggcttcctgaggcccccaagaatggaatggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgccactcagaccaagctccactccattttctataagctcctcttcgatgtactctcttccccatccctcaccaaagctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgccaattacctgtggacacccaggcaaccctgtcaacggcctcactcagggtaaccagtttaacctcaacgatgtggtcaagtttgtttgcaaccctgggtatatggctgagggggctgctaggtcccaatgcctggccagcgggcaatggagtgacatgctgcccacctgcagaatcatcaactgtacagatcctggacaccaagaaaatagtgttcgtcaggtccacgccagcggcccgcacaggttcagcttcggcaccactgtgtcttaccggtgcaaccacggcttctacctcctgggcaccccagtgctcagctgccagggagatggcacatgggaccgtccccgcccccagtgtctcttggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccagtgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacaggatgccaagtctgggggcagcagcagggtccttgagagaacaggggagcaagcctgccccagtacccaaaaaacaatggctatcatgtactggggttattctctgtgcctgacactttacctgtagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaatctctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgc

SEQ ID NO: 7068 - DNA, 3824 bp, Homo sapiens
gagagacagacaaacagcacaagagacagaaacaaagcaggcagcaccataggtagggaagtattttttttttaagtttgagaggcatttctgtagacagtccaacaactggacagacacgcaggcaccttggcaggtagacaggcaaacgacttgtcatctttgtcaggttcttcagagctgtgagttgctttctggatgcagctgatgggggttaatctatggttattgtgattctctttccagctgagtgtgggaattcagtcacaggcactcagggtactttgctgtcccccaactttcctgtgaactacaataacaatcatgaatgcatctactccatccagacccagccagggaagggaattcagctgaaagccagggcattcgaactctccgaaggagatgtcctcaaggtttatgatggcaacaacaactccgcccgtttgctgggagtttttagccattctgagatgatgggggtgactttgaacagcacatccagcagtctgtggcttgatttcatcactgatgctgaaaacaccagcaagggctttgaactgcacttttccagctttgaactcatcaaatgtgaggacccaggaacccccaagtttggctacaaggttcatgatgaaggtcattttgcagggagctccgtgtccttcagctgtgaccctggatacagcctgcggggtagtgaggagctgctgtgtctgagtggagagcgccggacctgggaccggcctctgcccacctgtgtcgccgagtgtggagggacagtgagaggagaggtgtcggggcaggtgctgtcacccgggtatccagctccctatgaacacaatctcaactgcatctggaccatcgaagcagaggccggctgcaccattgggctacacttcctggtgtttgacacagaggaggttcacgacgtgctgcgcatctgggatgggcctgtggagagcggggttctgctgaaggagctgagtggcccggccctgcccaaggacctgcatagcaccttcaactcggtcgtcctgcagttcagcactgacttcttcaccagcaagcagggctttgccattcaattttcagtgtccacagcaacgtcctgcaatgaccctgggatcccgcagaatgggagtcggagtggtgacagttgggaagccggcgactccacagtgttccagtgtgaccctggctacgcgctgcagggaagtgcagagatcagctgtgtgaagatcgagaacaggttcttctggcagcccagcccgccaacatgcatcgctccctgcgggggagacctgacaggaccatctggagtcatcctctcaccaaattacccagaaccctacccgccaggcaaggagtgtgactggaaagtgaccgtctcaccagactacgtcatcgccctggtatttaacatctttaacctggagcctggctatgacttcctccatatctacgacggacgggactctctcagccctctcataggaagcttctatggctcccagctcccaggccgcattgaaagcagcagcaacagcctcttcctcgccttccgcagcgatgcatctgtgagcaatgctggcttcgtcattgactatacagaaaacccgcgggagtcatgttttgatcctggttccatcaagaacggcacacgggtggggtccgacctgaagctgggctcctccgtcacctactactgccacgggggctacgaagttgagggcacctcgaccctgagctgcatcctggggcctgatgggaagcccgtgtggaacaatccccggccagtctgcacagccccctgtgggggacagtatgtgggttcggacggagtggtcttgtcccccaactacccccagaactacaccagtggacagatctgcttgtattttgttactgtgcccaaggactatgtggtgtttggccagttcgccttctttcacacggccctcaacgacgtggtggaggttcacgacggccacagccagcactcgcggctcctcagctccctctcgggctcccatacaggagaatcactgcccttggccacctccaatcaagttctcattaagttcagcgccaaaggcctcgcaccagccagaggcttccactttgtctaccaagcggttcctcgaaccagcgccacgcagtgcagctctgtgccggaaccccgctatggcaagaggctgggcagtgacttctcggtgggggccatcgtccgcttcgaatgcaactccggctatgccctgcaggggtcgccagagatcgagtgcctccctgtgcctggggccttggcccaatggaatgtctcagcgcccacgtgtgtggtgccgtgtggaggcaacctcacagagcgcaggggcaccatcctgtcccctggcttcccagagccgtacctcaacagcctcaactgtgtgtggaagatcgtggtccccgaaggcgctggcatccagatccaagttgtcagttttgtgacagagcagaactgggactcgctggaagtatttgatggtgcagataacactgtaaccatgctggggagtttctcaggaacaaccgtgcctgcccttctgaacagcacctccaaccagctctaccttcatttctactcagatatcagcgtatctgcagctggcttccacttggagtacaaaacggtgggcctgagcagttgtccggaacctgctgtgcccagtaacggggtgaagactggcgagcgctacttggtgaatgatgtggtgtctttccagtgtgagccgggatatgccctccagggccacgcccacatctcctgcatgcccggaacagtgcggcgatggaactaccctcctccactctgtattgcacagtgtgggggaacagtggaggagatggagggggtgatcctgagccccggcttcccaggcaactaccccagtaacatggactgctcctggaaaatagcactgcccgtgggctttggagctcacatccagttcctgaacttctccaccgagcccaaccacgactacatagaaatccggaatggcccctatgagaccagccgcatgatgggaagattcagtggaagcgagcttccaagctccctcctctccacgtcccacgagaccaccgtgtatttccacagcgaccactcccagaatcggccaggattcaagctggagtatcaggcctatgaacttcaagagtgcccagacccagagccctttgccaatggcattgtgaggggagctggctacaacgtgggacaatcagtgaccttcgagtgcctcccggggtatcaattgactggccaccctgtcctcacgtgtcaacatggcaccaaccggaactgggaccaccccctgcccaagtgtgaagtcccttgtggcgggaacatcacttcttccaacggcactgtgtactccccggggttccctagcccgtactccagctcccaggactgtgtctggctgatcaccgtgcccattggccatggcgtccgcctcaacctcagcctgctgcagacagagccctctggagatttcatcaccatctgggatgggccacagcaaacagcaccacggctcggcgtcttcacccggagcatggccaagaaaacagtgcagagttcatccaaccaggtcctgctcaagttccaccgtgatgcagccacaggggggatcttcgccatagctttctccgatcactgcagatattttaaccagaaatcaggaaagctggattttactcccagctccaccttgggccagctgtgtaaaaccttgcacaggtcccttccccacttgagacttcagtttcttcacctgtag

SEQ ID NO: 7069 - DNA, 13212 bp, Homo sapiens
tggtggttgctataacgagccagaattggggtagattttggtggaggggaaaaaacgcacaagaaaagacagaatccagagtagcggagactttgtgcccccgttggagagatggttgagtcctcgtcaaggttgctgtggtatcccagaaacaccattcactccgagctgtgaccgcgcaccaacaacagcaacaactccactgcgccgggctgaggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaa

SEQ ID NO: 7070 - DNA, 13018 bp, Homo sapiens
tacacccctcggccctttggaggaccggagagccggacgacgccgcagcccttgggggagtccagcgccagctggcgaaaagaagcttcatcttccagatcatccgggaaaggggcagaggtggccggttgttgcgactcataaacaacctcttcagcacaacccggttgaatgtggagttggttcctttgctggaaacctgtacagcttgaccgacagacagcctcaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaa

SEQ ID NO: 7071 - DNA, 12912 bp, Homo sapiens
gagactttgtgcccccgttggagagatggttgagtcctcgtcaaggttgctgtggtatcccagaaacaccattcactccgagctgtgaccgcgcaccaacaacagcaacaactccactgcgccgggctgaggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaaggttcttctacattgacccacactacctccactggtgagttagaggagcataacaggactaccactggtgctattgctgttgctagcacacctgcagatgttactgtatccagtgttacagctgtcaccatccatagactttccgaggaacagcgagtgcaagttacgagtctcagaaattcaggtctggaccccaacacgtccaaggacgggctctctcctcatccagcagatacacaaagtaccaggagaagaccaagacatgctgaacagatagaaagaactaaagagcttgcagttgttactcatagagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttgttacatgtccaagcatcaattcctttatcttggaacatggaagatggcgaattgtgaatggctcccattatgaatacaaaaccaaagtagttttcagctgtgaccctggttatcatggactaggtcctgcctccatcgaatgtcttcctaatggtacttggagttggagaaatgaaagaccatattgccaaattatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgt

SEQ ID NO: 7072 - DNA, 12485 bp, Homo sapiens
ggagcaggaattaggagctcgcgaataatatgaaagggatccgcaaaggggaaagccgagcaaaggaatccaaaccctgggagcctggcaagcgaagatgcgctaaatgtggccgcctagacttcatcctgatgaagaaaatggggattaaaagtggatttacgttttggaacctcgtctttttattgacggtgtcttgtgtgaaaggatttatttatacatgtggtggaactttaaaaggacttaatggcactatagaaagccctggttttccatatggatatccaaatggtgcaaactgcacatgggtaataatagcagaagaacgaaatagaatacaaattgtttttcagtcatttgctctagaagaagaatacgactacttatcattatatgatggacatcctcatcctacaaactttaggacaaggttaacaggattccatctgccacctccagtgacaagtaccaaatctgtgttctcactacgtttgaccagtgattttgcagttagtgctcatggatttaaggtatattacgaagaattgcagagtagctcttgtggaaatcctggtgttccacccaaaggtgtattatatggcacaagattcgacgtcggggacaagatccgctacagctgtgtaactggatacatccttgatggccaccctcagctcacctgcatagccaattcagttaatacagcttcgtgggattttcctgttcctatctgtagagctgaagatgcttgtggaggaacaatgagaggatccagtggcatcatatccagccctagttttcctaatgagtaccataacaatgctgattgcacttggaccattgtagcagagcctggggacacaatttcactcatatttactgattttcaaatggaagagaaatatgattacttagaaatagaaggttctgagccacctaccatatggttatctggaatgaatataccaccaccaattatcagcaacaaaaactggctcagactgcattttgttacagacagcaatcatcgataccgtggatttagtgctccctatcaagtgaaaaaggccatagattttaaatctagaggatttaaattgtttccagggaaagacaacagcaacaagttttctatcttaaatgagggaggtattaaaacagcttccaatttatgcccagatccaggagaaccagaaaatgggaagagaatcggatcagattttagccttggatcaactgtgcagttctcttgtgatgaagattatgtcctacagggcgcaaagagcatcacctgtcaacggatagctgaagtttttgctgcttggagtgatcacaggcctgtgtgtaaagtgaaaacgtgtggctctaatcttcaaggaccaagtggtacctttacatctcccaactttccgttccagtatgacagcaatgcacaatgtgtctgggtcatcacagcagtgaatacaaataaggttatccagataaattttgaagaatttgatctggagattggctatgataccttgacaattggcgatgggggcgaagttggagatcctaggacagtgctccaagtgctgactggaagctttgtaccagacttgatagtgagcatgagtagccaaatgtggctgcaccttcaaacggacgaaagtgttggatctgttggtttcaaggttaactacaaagaaattgagaaagaaagttgtggtgatcctggtacacccttatatggaattagagaaggcgatggattttctaatcgtgatgttttaaggtttgaatgccagtttgggtttgaattaattggagagaaatccattgtttgtcaagagaataaccaatggtctgcaaacatacccatctgtatctttccctgcctgtctaactttactgcaccaatgggaacagttctttctcctgattacccagaagggtatggaaataatttaaattgcatctggacgataatctctgatccagggagccggatacatctttctttcaatgactttgacctggaatcccagtttgatttccttgctgttaaagatggtgactctccagaatccccaattcttggaacctttactggggctgaggtgccttcccatcttactagtaatagtcacatactgcgattggaatttcaggctgaccactcaatgtcaggacgtggctttaacatcacttacaacacatttggacataatgaatgccctgatcctggaataccaatcaatgcacggcggtttggggacaactttcaattaggaagttcaatttcagttatttgtgaagaaggatttattaaaacccagggaacagaaacaattacatgtattcttatggatggaaaagtaatgtggagtggactgattccaaaatgtggagccccatgtggtggccatttttcagctcccagtggagtgattctctcaccaggatggccaggatactacaaagactctttgaattgtgagtgggtgattgaagctgaacctggacactctatcaaaattacatttgaaagatttcagactgaactgaattatgatgttctggaagttcatgatgggccaaatcttctgtcacccttgcttggatcttacaatggcacccaagtgccccagtttctatttagtagcagtaattttatataccttctatttacaacagacaacagtcgttccaataatggtttcaagattcattatgaaagtgttacagtgaacacgtattcttgtttggaccctggcatacctgtacatggccgtcgctatggtcatgatttctccattggctctactgtttcatttagttgtgattcaggatacaggttgagtcatgaagagccccttctatgcgaaaaaaaccactggtggagtcatccacttccaacctgtgatgcattatgtggaggagatgttagagggcctagtggaacaatcttatcacctggttacccggaattttatccaaattctctgaattgtacatggactgttgatgtaacccatggaaaaggtgtgcagttcaacttccacacttttcatttggaagaccatcatgactacttactgatcacagagaatggcagttttacccaaccactggcacgcctgactggttcagatcttcctccaacaatcaatgctggtctctatggaaatttcagggctcaattgcgtttcatttcagatttttcaatatcatatgaaggatttaacataacattctctgaatataaccttgaaccttgtgaagatcctggcattcctcaatatggtagtcgaatcgggttcaactttgggattggtgacactctgaccttctcatgctcttcgggttatcgactggaaggaacatcagagatcatctgtcttggtggtggccgacgagtgtggagtgcacctctgccaaggtgtgtggctgaatgtggtgcatctgcaacgaataatgaaggaattttgctgtctccaaattatccactcaactatgaaaacaaccatgaatgcatttatagtattcaggttcaagcaggaaagggaatcaatatttcagccagaacatttcatttagcacaaggagatgttcttaagatttatgatggaaaagataaaacgactcatctactaggtgcttttactggtgcatctatgcgcggactgacacttagtagtacttcaaatcaactctggctagaatttaattccgatactgaagggacagatgaaggctttcaacttgtgtataccagttttgaactctcacactgtgaagatcctggcattccacaatttggatacaagatcagtgaccaaggccactttgctggtagcaccatcatttatggatgcaatccaggctacactctccacggaagtagccttctcaagtgcatgacaggggagagaagggcatgggactatcctctgccttcctgtattgctgaatgtggaggtcgttttaaaggagaatcatcaggaagaatcttatctcctggctatccttttccatatgacaataacctgcgttgcatgtggatgattgaggtagatcctggaaatattgtcagcttgcagtttcttgcttttgatacggaagcatcacatgatatactccgagtctgggacggtccaccagaaaatgatatgcttttaaaggaaattagtggatctcttattcctgaaggaattcatagcaccctcaatatagtaaccatccagtttgacacggatttttatattagcaaatctggatttgcaattcagttttcaagttctgttgccactgcgtgtcgtgacccaggggtccccatgaatgggactcgaaatggggatggaagagaacctggggacactgttgtttttcaatgtgacccaggatatgaacttcaaggagaggaaagaataacctgcattcaggtagaaaatcggtacttctggcagcccagcccaccagtctgtatagcaccctgtggaggcaatttaacaggatcttcaggctttattctttcaccaaacttccctcatccatatccgcatagcagagactgtgactggactatcaccgtcaatgcagactatgttatctccttggcgttcatcagttttagcatagaaccaaactatgacttcctctatatctatgatggaccagacagtaatagcccactgattggaagttttcaagacagcaagttaccagagagaatagaaagcagctcaaatacaatgcatttggcttttcggagtgatggatctgttagttacactggatttcatctagaatacaaagcaaaactgcgagagtcctgctttgatccaggcaatataatgaatggcaccagacttggaatggattataaattagggtcaacagtcacctattactgtgatgctggttatgttcttcaaggttattcaacactcacctgtatcatgggagatgatggaagacctggatggaatagagccttgccaagttgtcatgcgccctgtggaagtcgttcaacaggttcagaaggcactgttctatcaccaaactatccaaaaaattacagtgtgggacataattgtgtttattctatagcagttccaaaggagtttgtggtgtttggccagtttgtatttttccagacatcactccacgatgttgttgaggtgtatgatgggccaactcagcaatcttctctgttatcttccctctcaggatcccattcaggagaatcacttccactgagttcaggtaatcagatcacaattcgatttacttcagttggaccaataacagctaagggatttcactttgtttaccaagctgttcctagaacaagttctacacaatgcagttctgtgcctgaaccaagattcggaagaagaattggcaatgaatttgcagtcggttcatcggttctttttgattgtaatccaggatatattctccatggatccatagcaattaggtgtgaaacagtgcccaattctttggcccagtggaatgattccttacctacttgtattgtgccctgtggtggaattttaactaagcgcaaagggactattttgtcacctggataccctgagccttatgacaacaatctgaattgtgtgtggaagatcacagtgccagagggagctggcattcaagtgcaagttgttagctttgctacagaacataattgggattctctggacttttatgatgggggagacaacaatgctccaagacttggaagctattcaggaacaacaataccccatcttttgaatagtacgtctaataatctgtatctaaattttcaatcagacatcagtgtttctgctgcaggatttcatcttgaatacacagcaattggtttggattcctgtcctgaaccacaaactcctagcagtggaattaaaattggagacagatatatggttggagatgtagtatcctttcagtgtgatcaaggatattctcttcagggtcactctcacattacatgtatgccaggacctgtaagaagatggaattatccaatcccaatttgtttagctcagtgtggtggtgctatgtcagacttcagtggtgtgatcctcagtcctgggtttcctggaaactatcccagcagtttagattgcacatggacaataaatctacccataggttttggtgtacatctccagtttgtaaatttttctacagaaaccatacatgattatttggaagtacgaagtggatcctcagaaactagtactgttattggccggcttagtggtcctcaaataccatcttccttattcagcaccacccatgaaaccagcttatattttcacagtgactattcacaaaacaaacaagggtttcatattgtataccaagcctatcagttgcaaagctgtcctgatccacgcccgtttcgaaatggttttgtaattggtaatgattttactgtgggtcaaaccatttcatttgaatgtttcccaggatacacattaattggaaattcagctctcacatgccttcacggagtcagtcgtaattggaatcatccacttccaaggtgtgaagctctttgtggtgggaatataactgcaatgaatggcaccatttattctcctgggtatcctgatgaatatccaaactttcaagattgtttttggcttgtaagagtaccccctgggaatggcatctacatcaattttactgtccttcaaacagaaccaatatatgatttcattactgtatgggatggaccagaccaaaattcacctcagatcggtcagttcagtggcaataccgctttggaatcagtctacagtacttcaaatcagattctaatcaaattccacagtgatttcacaacaagtggcttttttgtgctcagttatcacgcctatcaactaagggtgtgccaacctccaccacctgtgcccaatgctgaaattttgacggaagatgatgaatttgaaataggtgatattattaggtatcagtgtcttccaggatttactttagttggtaatgcaattctgacgtgcagattaggagaacgactgcagatggatggagcacctccagtttgtcaagtgctctgtcctgccaatgaattacggctagattctactggagtcatattgagccctggatatcctgacagttacccaaatcttcaaatgtgtgcatggagcatttcagtggaaaagggttataatatcaccatgtttgtagaattcttccagacagaaaaggaatttgatgttcttcaggtgtatgatggaccaaatattcaaagtccagtgcttatttccctcagtggggattattcatctgcttttaatataacaagcaatggtcatgaagtatttcttcagtggtcagcagatcatggcaataacaaaaaaggcttccggataagatatatagctttctactgtagtacaccagaatccccacctcatggatatattatcagtcagacaggtgggcagcttaacagtgtggtccgttgggcctgtgatcgaggattccgacttgttggaaaaagcagtgctgtgtgcagaaagtcttcctatgggtatcatgcatgggatgcgccagtccctgcctgtcaagcaatttcctgtgggattcctaaagctccaacaaatggaggaatactaacaacagactatttggtaggaacgcgagttacctatttttgtaatgatggatatcgattgtcatccaaagaactcactacagctgtatgccaatcagatggaacatggagcaatcataacaagacccctcgctgtgttgttatttcctgtggagaactacctacacctccaaatggaaataagattggaactcaaacttcatatggctcaacagctatctttacctgcgacttgggattcatgcttgtgggctctgctgtaagggaatgcctttcctcaggtctttggagtgaatctgaaaccagatgcctagcgggtcattgtggaattccagaactgattgtgaatggtcaagtcattggagaaaattatggatatagagacacagttgtatatcaatgtaatcctggttttcgattgattggttcttcagtgaggatatgtcaacaggatcacaattggtctggtcagctcccatcctgtgtgcctgttagctgtggtcaccctggtagtccaatttatggaagaacaagtggaaatgggttcaactttaatgatgtggtaacattctcatgcaatattgggtatcttatgcaagggccaacaaaggcacagtgccaggccaacagacagtggagccatcctccacctatgtgcaaagtggtcaactgttctgatcctggaattccagccaattctaaaagagaaagtaaaatagaacatggaaattttacttacggcactgtggtattctatgactgcaatcctggatattttttatttggatcttcagttttgatatgtcaaccaaatggacaatgggacaaacctttaccagaatgtatcatgattgactgtggacaccctggcgttcctcctaatgcagtcctgtctggcgagaagtatacttttgggtctactgttcactattcctgcacaggaaagcgttcccttttaggccagtcatcaagaacctgccaattgaatggccattggagtggatcacaacctcattgttcaggtgatgctactgggacatgtggcgatccaggtactcccggccatggctctagacaggaaagcaatttcagaactaaaagtactgtacgttatgcttgtgatactggttacatccttcatggctcagaagaaagaacatgtttagctaatggcagttggaccggaaggcagccagagtgcaaagctgtgcagtgtggtaacccaggaaccacagccaatgggaaagtcttccgaattgatggcacaacattttctagttcagtcatttattcctgcatggagggatacatcctttctggaccttcagttagacagtgcacagccaatggaacatggtctggaactttacctaactgtacaataatcagttgtggagacccaggtataccagccaatggactgagatatggagatgattatgtggttggacaaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgt

SEQ ID NO: 7073 - DNA, 6006 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataacttgatccattccagacgctttgctgagtttcataaagcagggcactgagacacccgtccgtgttcctaaccagaaatcctaaagaagaggaattatacagaaggaacagcaggaggttttcctggacaccgccaacttcacattgctcagtggactcattctaagggcaagacattgaaaatgatgaattccaatctggatacagtcatgacagctcatgtgctcctcaacttaggctgtgcggttagccagcctgtaatgagaggagagaggcctgagtcacctagcatagggttgcagcaagccctggattcagagtgttaaacagaggcttgccctcttcaggacaacagttccaattccaaggagcctacctgaggtccctactctcactggggtccccaggatgaaaacgacaatgtgcctttttattattatttatttggtggtcctgtgttatttaagagatcaaatgtataaccacctagctcttttcacctgacttagtaataactcatactaactggtttggatgcctgggttgtgacttctactgaccgctagataaacgtgtgcctgtcccccaggtggtgggaataatttacaatctgtccaaccagaaaagaatgtgtgtgtttgagcagcattgacacatatctgctttgataagagacttcctgattctctaggtcggttcgtggttatcccattgtggaaattcatcttgaatcccattgtcctatagtcctagcaataagagaaatttcctcaagtttccatgtgcggttctcctagctgcagcaatactttgacatttaaagagaaatttagagaatattctcatcctctaaaaatgtttaaatatataccaaacagtggccccctgcattagttttctgttgccactgcaacctattacttggtagcttaaaaacaacacattagcttatagtcctggggatcagaattccaaaatggatgtccctgaatgaaaatcaaggtgtcagcagagctgtgctccttctgaaggctctagggagaagccggttccttgccatttcaagcttctagaggctggctgcattcccaggctccagtggctggtcaagcttttctcacatggcatcactgtgacactggccctcccacttccctctttgacttacaaagcccaccaggaagatccaggataatctctccatctaaagttccttcatcatcctggaagagccttttgccatgcaagacaacatagccacaggtggggattaggaccagaacatctttggggtgctgttattctgcctaccacaccttcctgccactgactcccacaggagaggctacaaaatgatctggcgcacagggatgttttgtttagcttgcggactctaacacttaaaaaaaaacccagatcagaagatctggccatgctggggctcacattctcacctagcaacaactggctggagctgggcaccagctctgcctttagaaggggtgtccacttcaccaggtcaccacagcccacactacgccctatcacttcccacaatgaggctgagtgtttgtttctactgatcaatgcccctgcaggttgcatttattgtaatgaaaaagaaagactgggattaatctctaatcaggtgagtagaccatgagaccaatgtgtgctcacattaccctttttcttttttttctttttctttttctttttttttttaatgtgagacaggatctcattctgttgcctaggctggagtgcagtggcgcaatctcggctcactgcaacctctgcctcctgggctcaagcaattctcccacctcagcctcccaaatagctgggatcactggcacaaaccaccatgcccagctaattttgtattttttgtagagacagggtttcaccatgttgcccaggctggtctcaacctcctgggctcaagcaatcctcctgcctcggcctcccaaagtgctgggattacagatgtgagccaccgcatccagccccacaccctcatttataccaattacctgcccagtaactgtggacttttgcttcctcacccctgctctgatctggaaggagagggattatgttatagcttgtcagcacagtcccaagttcaatatttctgcggcaaaaacttccttcaaaaaataaatgtacttcattgtattcaatgaattcaccttggaaatgcaccgcctcaacttgttcacatggcataaatgaaaggaattttatagtctcctaaatggcgtgtactgcaagacctcttgaacactttccagaggataggatatttaagtcatgcccttggcgttgcctatggcacctttcccttctgaaagtctggttcctgcccagtgacccttggccttgtgagccgagatgctgaccctgcataaagggccaaaggagggctgcggcttccttccctcactgaagagcccttatttgaattcactgtgtggagccctagccctccattctcgacattccccaacctcccagccccttccaagcaggactaggtgccctgcattccacccaaggtgggattggccttccttaggctggctacttgtcaccatcaccgacatcactgttgcctgcaaggacaccacgtggccattttccttcaactgagggctcaaaactcctggacaagttgctggctcctgagaccagtatttcctggagctgtgcctcagtgaaggggcccagcctgaggaaccctggctcttttctttaaagcccaggccccacttacgtaaaacatttcagggtcactggaaacagtgaagtgccatttgttgaagcctactgcatgccagcccactgctcatccacgtggtctgccatgcctacgaggaaggccagcgcatgcaggactggtctctaatgctgtggtcattgcacagaagggaaaggtctcaaggaagagtcaactggaacaagcacaagcccaccggacatggccttggtaaaggttagcagactggtgtgtgtggatctgcagtgcttcactggaaataatttattcattgcagatactttttaggtggcattttattcatttcctgtgctttaaataaacaaatgtaccaaaaaacaagtatcaagctgtttaagtgcttcggctacttgtcccctggttcagtagaggccccggtttcccagttgttgactgtgacaggctcagcatgggctcagcagatgctgtcttaatttgtggatgatacagaaagccaggctttgggatacaagttctttcctcttcatttgatgccgtgcactgtgtgaagcagatgtttttgtccggaaataaaaataatagtcttggagtctcgcc

SEQ ID NO: 7074 - DNA, 1416 bp, Homo sapiens
gggcggggctcgggccggtccgcccgcgcgcaggtgagtgagccagggcggagcgcagctgcgccgggcttgggcgcctggggccgccgctccccaccgtcgttttccccaccgaggccgaggcgtcccggagtcatggccggcctgaactgcggggtctctatcgcactgctaggggttctgctgctgggtgcggcgcgcctgccgcgcggggcagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtgagccccactttcctttttcttcctcctccagcaccttcgttgtttcctgggtagtctgcctgggtgaggctcccttcctgtttctcatctgtggcttctgaaacacttagactctggacccagcaagagtttcaggaagtgggttgctaggcagttagacaggcttgttggtgaacacccggtatgtagttccatttcagcacaataaaaagaaatcttgcattcaagatgctaaattgtttttaacgaa

SEQ ID NO: 7075 - DNA, 705 bp, Homo sapiens
tggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaaggtgagtcatctactctttggttaagaatgatggcaggtcagcatctgtggtttccttggaatcatcaggcatatttaattctccatctaaagtttctaggattctgtggcctcccaaatcaaattgaaatataccaggtatgctaaaacccaaacagtggtgagtatgattgtataa

SEQ ID NO: 7076 - DNA, 11949 bp, Homo sapiens
ttctccaaaatcccatgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgttttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagaaatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcgtcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctgttctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttcgctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacatacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctcaaaaaaaaaagaaacaaaaaaaaccagaatcaatatttgtacattttctcgaacatagaatatagcttctttagtcttgagtgtgcatttcattctaatattttgagctgaaatttaaaaaaactttgaaagagttggaaatgattatggcatatgtgacatacatttttaaaagttaataataatagccaggggcagtggctcatacccataatcccagcacgctgggaggccatgatgggaggattgcttgaacctaggagtttgagaccagcctgggcaacaaagtgagacctgatttttacaaaaaatcaaaaaattagccaggcatggtggcatgcacccgtggttccagctacacaggaggttgaagcaggaggatcacttgagcccagtaggttaaggctgcagtgaaaccctgtgaattaaccactgtactccagcctgggtgacagactgagaccctatctcaaaaatgacaacaagaacaacaaaagttaatgataatatagaagcataaatttcctgtgaatgttcaattacacataataaacattattgaattgtacacaatt

SEQ ID NO: 7077 - DNA, 958 bp, Homo sapiens
aattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgccacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaa

SEQ ID NO: 7078 - DNA, 599 bp, Homo sapiens
agcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagaaatcatcgtgttctcttgaacttcactgactttgatcttgaaccacaagactcttgtattatggtttaatcatacttggtcggacgtcagacagatggggtttgtatattggctctgcactgctaagcgtgtgattgggcaagtcatgtatgttttcagagctcagttttccctgctgcaaagtggaactgtaagaatcaaatgtaaacaaatgtatttaagtacctatcagtgtctggttcagataagtatttgctgctattcctaatttttctattacaatgactcctgcttctattactattaacgctatgttaaagatcttaaggaatcttttaaaaaaattttctccctgagcaagatgaaacttagtaaacaagataaaaaatccagtagaaaaa

SEQ ID NO: 7079 - DNA, 1841 bp, Homo sapiens
agtagttgcaatgagtcacagctggaacgtcctgtggttaacattctgctctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacatacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatctctctaacaatataataattagccaggcgtggtggtgggtgcctgtaattccagccactcgagaggctgaggcaggagaattgcttgaacccaggaggcagaggttgcagtgagctaagatcacaccactacactccagcctgggcgagacggcaagactccatctc

SEQ ID NO: 7080 - DNA, 1191 bp, Homo sapiens
gcccttctcaaacatggccgccacggcgcctctggaagggaaccgctctgggccccgcctttgatctcgttggtggggctgggggatgagagctgcaccgcgcgggacaagtcgccggcggcgcccgacggagcagaagagagagcatggagctggagaggatcgtcagtgcagccctccttgcctttgtccagacacacctcccggaggccgacctcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggggcacaataggggacatgatgcagaagctctcagggcagctgagcgatgccaggaacaaagagaacctgcaaccgcagagctctggtgtccaaggtcaggtgcccatctccccagagcccctgcagcggcccgaaatgctcaaagaagagactaggtcttcggctgctgctgctgcagacacccaagatgaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccccaaccaggacctgcccagacgcctcagaggcccccaaaaggatgagctgaagtccttcatcctgcagaagtacatgatggtggatagcgcagaggatcagaagattcaccggcccatggctcccaaggaggcccccaagaagctgatccgatacatcgacaaccaggtagtgagcaccaaaggggagcgattcaaagatgtgcggaaccctgaggccgaggagatgaaggccacatacatcaacctcaagccagccagaaagtaccgcttccattgaggcactcgccggactctgcccgagccttctaggctcagatcccagagggatgcaggagccctatacccctacacaggggccccctaactcctgtcccccttctctactcctttgctccatagtgttaacctactctcggagctgcctccatgggcacagtaaaggtggcccaaggaaggtg

SEQ ID NO: 7081 - DNA, 1496 bp, Homo sapiens
gcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggaccc

SEQ ID NO: 7082 - DNA, 3246 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccttaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagc

SEQ ID NO: 7083 - DNA, 2335 bp, Homo sapiens
ctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccttaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagca

SEQ ID NO: 7084 - DNA, 1694 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagccaaaggccatggctatgcttccctggctccaagggcccatttcctcctagatgcccttttggcctttgtgagggagcgaggaacaggctcgaaggctccggggtatctgccttctgctgggctcctgtga

SEQ ID NO: 7085 - DNA, 1330 bp, Homo sapiens
agtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctg

SEQ ID NO: 7086 - DNA, 2444 bp, Homo sapiens
ttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccttaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaa

SEQ ID NO: 7087 - DNA, 3938 bp, Homo sapiens
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggagaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaaggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 7088 - DNA, 4016 bp, Homo sapiens
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgtggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 7089 - DNA, 4052 bp, Homo sapiens
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcactgatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 7090 - DNA, 4049 bp, Homo sapiens
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacaagatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcaatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 7091 - DNA, 4046 bp, Homo sapiens
gtccagcctgtttaaacggaaaggacagagatcctgtctgttcaatgtaaaaaaaaaaaaaaaaaaaaaaaaaagaaaaaaagaaaaaaaaaatcagatcagaccgagagagagaggagagagggagagagagagggagagagagagggagagagagaggagagggagggagggagagagagaggggggagagcagagagagagcgcgagcgcgagcgagcgagagaagaggagaaagagagagagcagagagcgagcggagagcgaggtgtagagaaaccgagggggagagaacccgagtgtgtgtatgcgtgtgcgtgtgtgagcgcgagcgagcgagagagaggagcgagagagtgtgagcgagaaagaataaaaggaaagaagattttctctatgtatataaagatggccacgttagcaaacggacaggctgacaacgcaagcctcagtaccaacgggctcggcagcagcccgggcagtgccgggcacatgaacggattaagccacagcccggggaacccgtcgaccattcccatgaaggaccacgatgccatcaagctgttcattgggcagatcccccgcaacctggatgagaaggacctcaagcccctcttcgaggagtttggcaaaatctacgagcttacggttctgaaggacaggttcacaggcatgcacaaaggctgcgccttcctcacctactgcgagcgtgagtcagcgctgaaggcccagagcgcgctgcacgagcagaagactctgcccgggatgaaccggccgatccaggtgaagcctgcggacagcgagagccgaggaggtagtagctgcctgcgccagcccccttcacatagaaaactcttcgtgggcatgctcaacaagcaacagtccgaggacgacgtgcgccgccttttcgaggcctttgggaacatcgaggagtgcaccatcctgcgcgggcccgacggcaacagcaaggggtgcgcctttgtgaagtactcctcccacgccgaggcgcaggccgccatcaacgcgctacacggcagccagaccatgccgggagcctcgtccagtctggtggtcaagttcgccgacaccgacaaggagcgcacgatgcggcgaatgcagcagatggctggccagatgggcatgttcaaccccatggccatccctttcggggcctacggcgcctacgctcaggcaatgcagcagcaagcggccctgatggcatcagtcgcgcagggcggctacctgaaccccatggctgccttcgctgccgcccagatgcagcagatggcggccctcaacatgaatggcctggcggccgcacctatgaccccaacctcaggtggcagcacccctccgggcatcactgcaccagccgtgcctagcatcccatcccccattggggtgaatggcttcaccggcctccccccacaggccaatgggcaacctgctgcggaagctgtgttcgccaatggcatccacccctacccagcacagagccccaccgccgcggaccccctgcagcaggcctacgccggagtgcagcagtatgcaggtccagctgcctaccctgctgcctatggtcagataagccaggcctttcctcagccgcctccaatgatcccccagcagcagagagaagggcccgagggctgtaacctgttcatctaccatctgccccaggagtttggggacgctgagctgatgcagatgttcctccctttcggcttcgtgagcttcgacaacccggccagcgcgcagaccgccatccaggccatgaacggcttccagatcggcatgaagaggctcaaggtgcagctgaagcggcccaaagacgccaatcgcccgtactgagcgccggcgggagcgtcccccgggggagaccaggactcgcacagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaaaaaggaaaaataacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagttt

SEQ ID NO: 7092 - DNA, 1851 bp, Homo sapiens
ccgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggtcccgagggctgtaacctgtttatctaccacctcccccaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgct

SEQ ID NO: 7093 - DNA, 1591 bp, Homo sapiens
attcagcctccccaggccccgtcggggaagtttgcacctgcggactccattgctttggttattttcacaaagccaggccggcggggcaggtccggccgcgggggacacggatgcccaggaccccaggctaatcggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctgggctgcactcacccccgctgctgggcaccaccgctgtgcctggcctcgtggctcccatcaccaatggctttgcaggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggag

SEQ ID NO: 7094 - DNA, 5008 bp, Homo sapiens
cgccgccgccgccgccggctcggtcccgcgcccgccatggcccgcctgacggagagcgaggcgcgccggcagcagcagcagctcctgcagccgcggccctcgcccgtgggcagcagcgggcccgagccccccggggggcagcccgacggcatgaaggacctggacgccatcaaactcttcgtgggccagatcccgcggcacctggacgagaaggacctcaagccgctcttcgagcagttcggccgcatctacgagctcacggtgctcaaagacccctacacggggatgcacaaaggctgtgccttcctcacctactgtgccagggattccgccatcaaagctcagactgccctgcacgagcagaagaccttgcccggaatggcgcggccaatccaggtgaagcctgcggacagtgaaagccgcggaggtagggaccggaagctgttcgtggggatgctgaacaagcagcagtcggaggaggacgtgctgcggctgttccagcccttcggggtcattgacgagtgcaccgtgctccgggggcctgacggcagcagcaaaggctgtgctttcgtgaagttctcctcccacacggaggcgcaggcggccatccacgccttgcatgggagccagaccatgccgggagcctcctccagcctggtggtcaagttcgccgacacggacaaggagcggacgctccggcgcatgcagcagatggtgggccagctgggcatcctgacgccgtccctcacattgcccttcagcccctacagtgcctacgcccaggctctcatgcaacagcagacaacagtcctgtccacctcgggcagctacctgagtcccggcgtggccttctcaccctgtcacatccagcagataggcgccgtcagcctcaacgggctgcctgccacacccatcgctcctgcctctggtgtcgtgccctttccaggtgggcaccctgccctggaaaccgtctatgccaatggccttgtgccctacccagctcagagcccgactgtggccgagacactgcatcctgccttctccggagtccagcagtacacagccatgtaccccaccgcggccatcacgcccatcgcgcacagcgtcccccagccgccgcccctcctgcagcagcagcagcgagaaggagtttggagacacggagctgacgcagatgttcctacccttcggcaatatcatttcctccaaggtgtttatggatcgagctaccaaccagagcaagtgtttcggcttcgtgagctttgataacccggccagcgcccaggcagccatccaggccatgaacggcttccagatcggcatgaagaggctcaaagtccagctgaagcggcccaaagacccgggacacccctactgaccgcgcccacagccgccctgaggctgtaggcatggcccaggtgagccgccaggcggccccacccccgcccaagccccccgtcttgtctgaaaccccctcccgcggcccacttcatgctccaaaccctccccaggtggggtgatgcttcaagaggctacaagaaacctccgggttgggttggcggggacagagctggatgtagacacccccgatccccctgtggttggggctggagcagagggtgggaatggggtagggactgaggtgagccagggcccagtgaggtcggttagggaatccttcccggagaaggctttgagggctgaatagaagttcacctgagaggccaggtttgctctgggggtgggggtgcggtggggagggggttctgtcctgtcctatgagtctgttttccctgctgaaaacccaacaccagacggaaatgccaagtgcccaccccagaccccaaaccctaaggttggaccccaactcggaaccaggagtggagcgtggaaggtggggacagtgctcagggcccagtccagttggcactgacagcttccagtgtccccgctccatttccactagttcccctgggacaagcggcccctcactgggtgtcattcctacccaatgagttgatggaaaagtgggattcgtgccccacccaccatcatgcaagaaaaacaagcaaaacgaaacccagactgtagtttgccatcagggcaaaccactttctcaacatttttttgtggggggatgaacagtaaaccttgtggggccactgtggaaacttaaccgtgggtctcaaaccttgatgagcctcatctgtaaaatgggttcaagaaagtcatctccccagagacggcggaaacggtccacctagggaacagagtggggcatcttttcgcagccgagcccagaacccatcacctaaagagttctggatgattcgttttgattttttttttttttaaatcaccatcgctgtcgtcatcagagtctcgcctagggcctggcacagagtagacgctcagttagaagctgtctggccttttcaccttctcccgggtcagcacacacagatttgggagtatttacctgcacagaacgcaccttcaggaactgccaaccagaagcaaaatccaaagctgctctctgcgatcccttcacttttaactctcagtctgcactttttttttttaactgagcatctattatgtgctaggcactgttccagtgctcggggacgcagctgtgaatgaacagaaacgggggatggaggacaggggagaaacccccttcacgggccttagatggcagggggtagggaaggagagacagaaaataaacagaaatatctgtccccagctgccagaggaggaggaaatgggcttggtgatggtgacattaagttctttgaaagctgggtttgttggcctctgaactctggcctttgtgggatctgttcttttggaaaagatgggagcccctgtgttcctagatcccagcctggccgggtggagtagggtggggaggtggtgtccacctgtgtggccccgttctcactccctaacgcccgtcccttctcccccaggtgaggggccttcccatcccaggagggttttctgcttccaaccgatccaggacttacccataaattccaaccgttctttggacaccagccctttcctcccctcttctccccttgccctgcccctctactggaggccacctggagtggcgaggggcctttggggtctgtcctggggcaggggcgggggtgggggaggctcctgaatcgtgggcagaagtgttcacacgccccccctgctttgggaaacgctctcgcttcttccccacaaaacttggtgacttccccaaactaaatcacaccttttcctatatatatatatatgcatatatatatagatctatagacagtatatatatattttgagtacggatcatgggaccaaacttttccgacttccttccatccgagtagagtgaccctgggccggtcactcagcgggggacacaggaagggctgaggttggcgggaccccgcgcaacacataccaggtgccccacccccacccccaccacctcctggctggcacatcccaccaggaacccgccaacacaacatacctccaggacttttggcaccccccaccaccaattctccagggccgttgggctctgccagcttcagtgtccctggtcccagctgcagcctccagaccccacctcgccccttcgtcccagagccctgccctccgggatggatataggtacaacagagacgctctggcctgcctcagcccttctctgctcccctgcccgagtcatagccttactcatgtgaccaatagcccttagctttccgtcggagggggggggcggacagggttggggggagcccccctgcccctcaccaccccctcccaaggccaggcagccattgtccctgccttcgaatcaccagcctcgaatttaaggtcttgtaaccaggattgccaagcgtagcggaagaccctacccggaccggccaagcacccctttaactggagacgaacttgataatgaccttcatacctctacagagatttttttttttttccggtctttctgagcaggtacaaagaagaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaaaaaaaaaaaaccaagcatttccttttctttctaccaaaatgtgttgactgacccggagggggggcggtagggtgggggaaaccacacagaaaaaaaaaaaaaaaaaaaaaagaaaagaaaaaagaaaaaaaaatagaaaagaaaaaaaaaaatcttctgaaccaacttgtttcgatattccagagtttgataattgtttcgagactctcctctagcgtgcctgtgttccgtgtgtccccgtgtgcaagcgtgtgccatgccaatctgcctcgagggggcctcacccgtgtccgcggcgcccgccgaggcccccgagggcctgcttgggagtgtgtgccggtgtgcagttgtacgtgtctttctggtccatgtttactggctgtaaataccatttttatactccacatcgcagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaa

SEQ ID NO: 7095 - DNA, 3345 bp, Homo sapiens
gcacggggacctcaagccagaccccagcgttcagccgccacctcggcccgggcccgccccgccccggccccgcccctttcctgcccgccccaccccctctacgcccctccacccggaccccgccccctgggcagccccccgccctctccgcccgggctccgccccctccccctggccctcgccaccggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 7096 - DNA, 2751 bp, Homo sapiens
atgatctcagatcccccctcaaacaacagctggaactctgttctctatcttctagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 7097 - DNA, 3081 bp, Homo sapiens
accggtccagggaggggacggcgggacaggcgggaccagtgggaccggcgggagggctgacagggcggggacatggccgcggcgccgggagggtcagcgcagcccgctggccccggcccgcgcctgggtttcagcaccgcggacagcggcgtcggcatgagcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 7098 - DNA, 2497 bp, Homo sapiens
agcgggctaaaccccggtcccgccgtacccatgaaggaccacgacgccatcaagctcttcgtggggcagatcccgcggggcttggacgagcaggacctcaagccgctgttcgaggagttcggccgcatctacgagctgacggtgctgaaggaccggctcaccggcctccacaaaggctgtgccttcctcacctactgcgcccgggactctgctctcaaggcccagagtgcactgcacgagcagaagaccctgccagggaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagcagccaactccccgcctggcagcggccctggcaccctcccaggtcttccggcgcccatcggggtcaatggattcggccctctgaccccccagaccaatggccagccgggctccgacacgctctacaataacgggctctccccttatccagcccagagccccggcgtggctgaccccctgcagcaggcctacgctgggatgcaccactacgcagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcct

SEQ ID NO: 7099 - DNA, 2854 bp, Homo sapiens
atcagtaccccttcctccatgaacgggaaggccgctgtttttccctcctggcactcagctgcctgccccccaacaataattcctcacctcccacgcacccagctcttggcagtttacaaagaccttttgcgtccccattacctcatgtgatccccacaacacccatgagaggaagatgaatcgtccgatccaagtgaagccagctgccagtgagggccgaggagaggaccgaaagctgtttgtggggatgctgggcaagcagcagggtgaggaggacgtcagacgcctgttccagccctttggccacatcgaggagtgcacggtcctgcggagtcctgacggcaccagtaaaggctgtgcctttgtgaagttcgggagtcaaggggaagctcaggcggccatccggggtctgcacggcagccggaccatggcgggcgcctcgtccagcctcgtggtcaagctggcggacaccgaccgggagcgcgcgctgcggcggatgcagcagatggccggccacctgggcgccttccaccccgcgccactgccgctaggggcctgcggcgcctacaccacggcgatcctgcagcaccaggcggccctgctggcggcggcacagggcccaggcctaggcccggtggcggcagtggcggcccagatgcaacacgtggcggcctttagcctggtagctgcgcctctgttgcccgcggcagccaactccccgcctggcagcggccctggcaccctcccaggtcttccggcgcccatcggggtcaatggattcggccctctgaccccccagaccaatggccagccgggctccgacacgctctacaataacgggctctccccttatccagcagcctatccgtcggcctatgccccagtgagcacagcttttccccagcagccttcagccctgccccagcagcagagagaaggccccgaaggctgtaacctcttcatctatcacctgcctcaggagtttggtgatgcggaactcatacagacattcctgccctttggagccgttgtctctgctaaagtctttgtggatcgagccaccaaccagagcaagtgttttgggtttgttagttttgacaatccaactagtgcccagactgctattcaggcgatgaatggctttcaaattggcatgaagaggctcaaggtccagctaaagcggcccaaggatgccaaccggccttactgacctgctttcactgaccagccacagaaagaaacagaagagtgagaagaaaggagaggaaaagcacagaaacgcttgagcagcccttcccgaaggagcagctgcggacggaggtggatcggacccaaggctggtgcctggggctaaggccactctaaggattgtttttatcaagtgggttgttctgtgcctgcagcatagagcgcaggctggcagagcaaatagggctggtgaggagtgactgtccaggggaaccagcagagggcgttgggggtgccaagggcttctccgcaagggaagcccagatttacttctttcaaaatcatatcattccttagagtttagggaccaaaggactattgcttttttaagaatatatatatctatataaattaaaacaaagaaacaaacaaacaaaaaacaagacaaacaactacaaaaaaagacagtatagagtctcataaaagctgcctttaaatatccctaggagacagggtgaaggagacccttgacagccccagcctaggcagatgggggctgtggaaagattgttctgtgtctcattccctcttaagccactcccccaccctgcccttttaaaaataattaaggatttgaggtctaggctcacatgcaggtaatgagaacgttatggaagcagtgaacccacaatccacaatccccaaactcagagtgcatcccagaagaggccccaggcagagctcaggttggccctggcctttgccatcccgggaggccccctagccagcaagagtgggattgcctttcctgtggaaccactgcttccccaggcgggaagaaagagggagttctggccacctgagcctttcccttgccaatccaggtagacagaggccctgcctttggctgagctgagacacctcctgtttcccttccccttgaaccagtcccagtgtccccttgctccaggctaccttctgtctcttagtctaagtttgcccacctgtaaagtagattcaggatatctgtagagggctgtgacaacagacttggaaggtttgctactgtatatactgccattgagaaggggaaatttttcaatatgtagaagcttcagaattagaggtccctctttaccccagacctgggagggaagtagatgttttgccaaaatacttcttcattcctttaaaaactacatctttcctatgcaagagtgtctcacatgtgcttaaccgaggtgcttctagttggtgagcagtgttgagcttagaagtggtgtgtgctctgtctgtctgtctttgtctgtctgttgtatacagtgggtgccatataaagctgatcaatggtggtgcttcctgcctgcttctgtgagatgggcaaaagattcagcttagaacaccatgactcaccttgccttggtcagcctttcctgggcctgtagggccttgcacatatttttcccaggaggatttcccctccaccccacaggcatggatcagcttggtctgaggccccagctgtgtggggtccctctaatccccagatgttgctgaggctgaaggcctctgatctgataacatgtcagatagtaaaagatgtgggggtgggggtggagggctcctccttcataacagtttctaagaaaacttgttcccacctgtt

SEQ ID NO: 7100 - DNA, 3643 bp, Homo sapiens
gtcctctcagccgggacgccagcggctctgattacagacctcggctgcccgacaactacacgcaggacacgtggcggaagctgcacgaggcggtgcgggccgtgcagagcagcacctccatcaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgcaaatgacacattc

SEQ ID NO: 7101 - DNA, 2364 bp, Homo sapiens
ggaggccgcgcggaccggggcgggcggagcggagctcggcgggcggcggcgctcggggcggggcgcggcggttccggcccagccatggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctga

SEQ ID NO: 7102 - DNA, 2502 bp, Homo sapiens
accgcccacagcgggccctcggcgtggcccgcaggcccttcggaccgcctgggagcgcggccacacgtgccagcaagtgagggcagcgacctgggaccgccgcgtctacttacaccgcgacgactccgcgatccacggacaccgcccggcccccacggcggccctgcaggggagaactcgggccgccttcccgagtcccggccgccgctgttcggctcgcgcggctgcccgccggggacccgaacggaagaagggtggcgaggcgggaaaggaaaaggcctgagggtccaaggcaggaggggacacacggaacacgccgagggccaaccacgccgccgcgcgctccccggctaggacccacctgctgcagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctga

SEQ ID NO: 7103 - DNA, 3724 bp, Homo sapiens
cctggggaccggctcggcgacgcgctcgggctgagggggcccggggtctttctgccggggccccgtcctctcagccgggacgccagcggctctgattacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctattttttttttcttataagttcgttgtgtctagagattgttaatattgtaatttaatgtagacttactttgaataaaattagtttaattggccttaaaattacattaataaaactttgtgatatgcaaatg

SEQ ID NO: 7104 - DNA, 3109 bp, Homo sapiens
ctcaagtcctgcggacctgggggcttcgggatctgggcgctatgaaaagtgtctgcccagtcacttccggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgc

SEQ ID NO: 7105 - DNA, 4902 bp, Homo sapiens
cgcacgcaggcatataaacgtaggtttttgatgctcctctgcctgttgaccccgctattttcatgtttccaacaggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctatttttctccaataaaacttttatttaaaaaaagtt

SEQ ID NO: 7106 - DNA, 846 bp, Homo sapiens
cttttttggtggagggttcattttccgggggtggttaggatccttgtgctgaagcatacaccgggtgtttctgtgcagtattttgaggtctttttcaacctattgtatttaatctgttattccttataacactgacaatcggtatgattgatccggattttgcagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattactt

SEQ ID NO: 7107 - DNA, 3264 bp, Homo sapiens
agttcagtttagaaactgccagtcttggtatagaacaacctaggcttatctgtttaagtcccataggtagtattattagagaataacccaggctttgggaactgtataactctgagatcgtttgaaattttcgttttgtttttcttttggctccaaccaggcctctgttgttagactaatggggtttcccctgcagagattggtcagccctgcagtctatcatcccggaaggtgttaaatacacatgaaagccagcctcggcgggcagaacctagcccgccgaaagggcgggcattgctaaagtgttttcaaaaggtcttcccaatcctctgctttagacagctcggaccttagatagaagaacacaacggatcctccagtgactgacgacccaaaggacggatgatgtcacagtcatctggatcaggagatgggaatgatgatgaggctactacctctaaagacggtggtttttcttcccccagtccctcagctgctgctgctgctcaggaggtcagatctgccactgatggtaataccagcaccactccgcccacctctgccaagaagagaaagttaaacagcagcagcagtagcagcagtaacagtagtaacgagagagaagactttgattccacctcttcctcctcttccactcctcctttacaacccagggattcggcatccccttcaacctcgtccttctgcctgggggtttcagtggctgcttccagccacgtaccgatacagaagaagctgcgttttgaagacaccctggagtttgtagggtttgatgcgaagatggctgaggaatcctcctcctcctcctcctcatcttcaccaactgctgcaacatctcagcagcagcaacttaaaaataagagtatattaatctcttctgtggcttcggtgcatcatgcaaacggcctagccaaatcttctaccaccgtctctagctttgctaacagcaaacctggctctgctaagaagttagtgatcaagaactttaaagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaa

SEQ ID NO: 7108 - DNA, 6351 bp, Homo sapiens
agctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggagaagagtgaggaagctcctggtgcttgggacgaggtcagcgctgtcggcgcgctgctccagcgcccaccacaccctggtgcgggccgacgggccctgggccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaagcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctcaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattggaattttgtttaaaattttacactttaaggtagcaaatgtcaattattagaccgagcatattgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttcttttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaaatttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatcca

SEQ ID NO: 7109 - DNA, 3596 bp, Homo sapiens
ccctggtgggagctccggcctccggtcaaggcctggccgggagcgccacgaattctcgcgtcgtctcgcgagagtccaagttaaagaacatggcgacgtctaatctgttaaagaataaaggttctcttcagtttgaagacaaatgggattttatgcgcccgattgttttgaagcttttacgccaggaatctgttacaaaacagcagtggtttgatctgttttcggatgtgcatgcagtctgtctttgggatgataaaggcccagcaaaaattcatcaggctttaaaagaagatattcttgagtttattaagcaagcacaggcacgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaagcttatgcttgatacatggaatgagtcaatcttttcaaacataaaaaacagactccaagatagtgcaatgaagctggtacatgctgagagattgggagaagcttttgattctcagctggttattggagtaagagaatcctatgttaacctttgttctaatcctgaggataaacttcaaatttatagggacaattttgagaaggcatacttggattcaacagagagattttatagaacacaagcaccctcgtatttacaacaaaatggtgtacagaattatatgaaatatgcagatgctaaattaaaagaagaagaaaaacgagcactacgttatttagaaacaagacgagaatgtaactccgttgaagcactcatggaatgctgtgtaaatgccctggtgacatcatttaaagagactatcttagctgagtgccaaggcatgatcaagagaaatgaaactgaaaaattacatttaatgttttcattgatggacaaagttcctaatggtatagagccaatgttgaaagacttggaggaacatatcattagtgctggcctggcagatatggtagcagctgctgaaactattactactgactctgagaaatacgttgagcagttacttacactatttaatagatttagtaaactcgtcaaagaagcttttcaagatgatccacgatttcttactgcaagagataaggcgtataaagcagttgttaatgatgctaccatatttaaacttgaattacctttgaagcagaagggggtgggattaaaaactcagcctgaatcaaaatgccctgagctgcttgccaattactgtgacatgttgctaagaaaaacaccattaagcaaaaaactaacctctgaagagattgaagcaaagcttaaagaagtgctcttggtacttaagtatgtacagaacaaagatgtttttatgaggtatcataaagctcatttgacacgacgtcttatattagacatctctgccgatagtgaaattgaagaaaacatggtagagtggctaagagaagttggtatgccagcggattatgtaaacaagcttgctagaatgtttcaggacataaaagtatctgaagatttgaaccaagcttttaaggaaatgcacaaaaataataaattggcattaccagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatggtctttagtagctttcccaaaactcaaacggcaagttttgttgtatgaacctcaagtcaactcacccaaagactttacagaaggtaccctcttctcagtgaaccaggagttcagtttaataaaaaatgcaaaggttcagaaaaggggtaaaatcaacttgattggacgtttgcagctcactacagaaaggatgagagaagaagagaatgaaggaatagttcaactacgaatactaagaacccaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttcttttttttttttttttggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaaa

SEQ ID NO: 7110 - DNA, 5254 bp, Homo sapiens
gtcgccgccagcgtctgtgccgcgtcccttgctctgtgaaggacaggcctcgcgccaggaccccggtggacttctgaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctgggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgattata

SEQ ID NO: 7111 - DNA, 5504 bp, Homo sapiens
aggaggtgctgcgtcgccaaggtggcatcctcggctccgccccggcgctctcccagggcccctagctttccgctgggtcgggcggaaatgagccgtggcttttggctggcggagccgctggcagggaccgggccccaccctgccccagtggctgccgactcacgcgggtgcagctctgttccgcggaggcacgccccctcccgtctctccgtctcgaccccctcgcggggcccaggtgccaggatggtgggagaactccgctacagggaattcagggtgcccctggggcccggcttacatgcctatcctgatgagctgatccgccagcgcgtgggccatgatgggcatcctgagtaccagatccgttggctcatcctgcggcgtggcgatgagggggacgggggctctggccaagtggactgcaaggctgagcacatcctgctgtggatgtccaaggatgagatctatgccaactgccacaagatgctgggcgaggatggccaggtcatcgggccctcccaggagtctgcaggggaggttggggccctggacaaatctgtgctggaggagatggaaaccgacgtgaagtccctcattcagagagcccttcggcagctggaggagtgtgtgggcactatccctcctgctcctctacttcacactgtccacgtgctcagcgcctatgccagcattgagcccctcactggagtattcaaggacccaagggtcctggacttgctcatgcacatgttgagtagtcctgattatcagattcgctggagtgcaggccggatgatacaagccctgtcctcccatgacgctggtgaggggcagtgtggggaggaagggaaagcaggagaagggctgggtcggctcagggactcacaggacactgtggcaggagcctctgatctcatcaggacccggactcagatccttctgtcactgagccaacaagaagccattgagaaacacctggattttgacagccgctgtgctctgctagcactgtttgcacaggccacgctctctgaacaccccatgtctttcgagggcattcagctaccacaggtcccaggaagggtgctcttctccctggtgaagcggtatttgcatgtcacctcgctcctggatcagctgaacgacagtgctgcggagccaggagcccagaacacctctgctcctgaggagttgagtggggagaggggtcaactggagctggagttcagtatggccatgggcaccctgatctcggagctggtgcaagccatgcgctgggaccaggcctcagacagaccaaggagctcagcacggtcccccggttccatcttccagcctcagctggcagatgtgagcccagggctccccgctgcccaggctcagccctccttcaggaggtcaagacgttttcgccctcgttctgagttcgcaagtggcaatacctatgctttgtatgtgcgggacacactgcagccggggatgcgagtgcggatgctggatgattatgaggagatcagtgccggggatgagggcgagtttcggcagagcaacaacggtgtgcctcctgtgcaggtattttgggagtcaacaggccgcacctattgggtgcactggcacatgctggagatcttgggctttgaggaagacattgaggacatggttgaggctgatgagtaccaaggggcagtggccagtagagtcctgggtagagccctgcctgcctggcgctggaggcccatgacagaactctatgctgtgccttatgtgctgcctgaggatgaggacactgaggagtgtgaacacctgaccctggctgagtggtgggaactcctcttcttcatcaagaagctggatggacctgaccatcaggaggttctccagatcctccaggagaacctagatggggagattctggatgatgagatcctagctgaactggccgtgcccatagaattggcccaggacttgctgctgactctgccacagcgactcaatgacagtgccctcagggacctgatcaactgccatgtctacaagaagtatgggcctgaagccctagcagggaaccaagcctacccatcccttctagaagcccaagaagatgtcctcctgctagacgcgcaggcccaggctaaggactcagaagatgcagccaaagtggaagcaaaagaacccccatctcagagtcccaacactcccctgcagcgtctggtggagggttatggtccagctgggaaaatcctcctggatctagagcaagccctcagctcagaggggacccaggagaacaaggtcaagccactcctgctgcagctgcagcggcagccgcagcccttcctggcactgatgcagagcctggacactccggagactaacaggaccctgcacctgactgtgctgagaatcctgaagcagctggtggacttccccgaggcactgctgctcccctggcacgaggccgtggatgcctgcatggcctgcctgcggtccccaaacactgatcgagaggtgctccaggaactgattttcttcctgcaccgcctgacctcagtgagcagggactatgccgtggtgctgaatcagctgggagcaagagacgctatctccaaggccctggaaaagcacctgggaaagctggagctggctcaggagctgcgggacatggtgttcaagtgtgagaagcatgcccacctctaccgcaaactcatcaccaacatcctgggaggctgcatccagatggtgctgggccagatcgaagaccacagacgaacccaccaacccatcaacatccctttctttgatgtgttcctcagatacctgtgccagggctccagtgtggaagtgaaggaggacaagtgctgggagaaggtggaggtgtcctccaacccgcaccgggccagcaagctgacggaccacaaccccaagacctattgggagtccaacggcagcgccggctcccactacatcaccctgcacatgcgccggggcatcctcatcaggcaactgactctgcttgtggctagtgaggactcgagttacatgccggcccgagtggtggtgtgcgggggtgatagcactagctctcttcacacggaactcaactcggtgaatgtgatgccctctgccagccgggtgatcctcctggagaacctgacccgcttctggcccatcatccagatccgcataaagcgctgccagcagggtggcattgatacgcgcattcgggggttagagatcctaggccccaagcccacgttctggccagtgttccgggagcagctctgtcgtcacacacgcctcttctacatggttcgggcacaggcctggagccaggacatggcagaggaccgcaggagcctcctgcacctgagttctagactcaacggtgctctgcgccaggagcagaattttgctgaccgcttcctccctgatgacgaggctgcccaagctctgggcaagacctgctgggaggccctggtcagccccgtggtgcagaacatcacctcccctgatgaggatggcattagccccctgggttggctgctggaccagtacctggagtgtcaggaagctgtcttcaacccccagagccgcggcccagctttcttctcgcgggtgcgccgtctcactcacctgctggtgcatgtcgagccctgtgaggcaccccctcctgtggtggccactcctcggcccaaaggcagaaacagaagccacgactggagctccttggctacccggggccttccaagcagcatcatgagaaacctgacgcgctgttggcgggccgtggtggagaagcaggtgaacaattttctgacctcatcctggcgggatgatgactttgtgccacgctactgtgagcactttaatattctgcagaactcaagctctgaactgtttgggcctcgggcagccttcttgctggcgctgcaaaatggctgtgcgggagccttgctgaagctcccttttctcaaagctgcccacgtgagtgagcagttcgcccggcacattgaccagcagatccagggcagccggatcggtggagcccaggaaatggagaggctggcacagctgcagcaatgcctgcaagctgtcctgattttctccggcttggagatagccaccacttttgagcattattaccagcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtcagagccaccctgcccttgagcgaggctcacagaggcgactgcagtggacgtggctgggctgggctgagctgcagtttgggaaccagaccctgcatgtgtccaccgtgcagatgtggctactgctgtatctcaacgacctgaaggcggtctctgtggagagtctgctggcgttctcagggctctccgcagacatgctcaatcaggcgattgggcccctcacctcttcaagaggccccctggaccttcacgagcaaaaggatataccaggaggggtcctcaagattcgagatggcagcaaggaacccaggtcgagatgggacattgtgcggctcatcccacctcagacgtacctgcaagctgagggtgaagacggccagaacttggagaagagacggaatcttctgaactgcctcatcgtccgaatcctcaaggcccatggagatgaggggctgcacattgaccagcttgtctgtctggtgctggaggcttggcagaagggcccgtgtcctcccaggggtttggtcagcagccttggtaaggggtctgcatgcagcagcactgacgtcctctcctgcatcctacacctcctgggcaagggcacgctgagacgccatgacgaccggccccaggtgctgtcctatgcagtccctgtgactgtcatggagcctcacactgagtccctgaacccaggctcctcaggccccaacccacccctcaccttccataccctacagattcgctcccggggtgtgccctatgcctcctgcactgccacccagagcttctctaccttccggtagccctagacttggggtcaggggaaggtagagctggagcttttacagaaataaaacccaagagtttgatt

SEQ ID NO: 7112 - DNA, 727 bp, Homo sapiens
gtccgggaaggccggtgcggaaggtggcgggggaggggacggtcggccgaaggctccccggggcgggccggcgggagtcgtagtcagtggtgatttcttctggagtcgtttcctcagctccttccagccccttgggcggcaccttctatctttgaggcgttaaaggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaa

SEQ ID NO: 7113 - DNA, 1346 bp, Homo sapiens
gctggggcgtaggtgtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggagcagcaaatggatttctcatggaagtttgtgttgattcagtggaatcagctgtgaatgcagaaagaggaggtgctgatcggattgaattatgttctggtttatcagaggggggaactacacccagcatgggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatggctatttgccgccctctgccagtcactttccaccgagcctttgacatggttcatgatccaatggcagctctggagaccctcttaaccttgggatttgaacgcgtgttgaccagtggatgtgacagttcagcattagaagggctacccctaataaagcgactcattgagcaggcaaaaggcaggattgtggtaatgccaggaggtggtataacagacagaaatctacaaaggatccttgagggttcaggtgctacagaattccactgttctgctcggtctactagagactcgggaatgaagtttcgaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaca

SEQ ID NO: 7114 - DNA, 2610 bp, Homo sapiens
agctgaattttttttttccctctctctttcttcactcctttttctttccaaacagggaaaagtgttccacgaagcggtagcgccttttcgcctcgcgttttcctccctgaccctggtcccggctcccgtccgggcgccagctggtggggcgagcgccgggagcccatctgcccccaggggcacggggcgcggggccggctcccgcccggcacatggctgcagccacctcgcgcgcaccccgaggcgccgcgcccagctcgcccgaggtccgtcggaggcgcccggccgccccggagccaagcagcagctgagcggggaagcgcccgcgtccggggatcgggatgtccctcctccttctcctcttgctagtttcctactatgttggaaccttggggactcacactgagatcaagagagtggcagaggaaaaggtcactttgccctgccaccatcaactggggcttccagaaaaagacactctggatattgaatggctgctcaccgataatgaagggaaccaaaaagtggtgatcacttactccagtcgtcatgtctacaataacttgactgaggaacagaagggccgagtggcctttgcttccaatttcctggcaggagatgcctccttgcagattgaacctctgaagcccagtgatgagggccggtacacctgtaaggttaagaattcagggcgctacgtgtggagccatgtcatcttaaaagtcttagtgagaccatccaagcccaagtgtgagttggaaggagagctgacagaaggaagtgacctgactttgcagtgtgagtcatcctctggcacagagcccattgtgtattactggcagcgaatccgagagaaagagggagaggatgaacgtctgcctcccaaatctaggattgactacaaccaccctggacgagttctgctgcagaatcttaccatgtcctactctggactgtaccagtgcacagcaggcaacgaagctgggaaggaaagctgtgtggtgcgagtaactgtacagtatgtacaaagcatcggcatggttgcaggagcagtgacaggcatagtggctggagccctgctgattttcctcttggtgtggctgctaatccgaaggaaagacaaagaaagatatgaggaagaagagagacctaatgaaattcgagaagatgctgaagctccaaaagcccgtcttgtgaaacccagctcctcttcctcaggctctcggagctcacgctctggttcttcctccactcgctccacagcaaatagtgcctcacgcagccagcggacactgtcaactgacgcagcaccccagccagggctggccacccaggcatacagcctagtggggccagaggtgagaggttctgaaccaaagaaagtccaccatgctaatctgaccaaagcagaaaccacacccagcatgatccccagccagagcagagccttccaaacggtctgaattacaatggacttgactcccacgctttcctaggagtcagggtctttggactcttctcgtcattggagctcaagtcaccagccacacaaccagatgagaggtcatctaagtagcagtgagcattgcacggaacagattcagatgagcattttccttatacaataccaaacaagcaaaaggatgtaagctgattcatctgtaaaaaggcatcttattgtgcctttagaccagagtaagggaaagcaggagtccaaatctatttgttgaccaggacctgtggtgagaaggttggggaaaggtgaggtgaatatacctaaaacttttaatgtgggatattttgtatcagtgctttgattcacaattttcaagaggaaatgggatgctgtttgtaaattttctatgcatttctgcaaacttattggattattagttattcagacagtcaagcagaacccacagccttattacacctgtctacaccatgtactgagctaaccacttctaagaaactccaaaaaaggaaacatgtgtcttctattctgacttaacttcatttgtcataaggtttggatattaatttcaaggggagttgaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctc

SEQ ID NO: 7115 - DNA, 5565 bp, Homo sapiens
gcacacagcgactggagacggacggagagcaacgcgctgggagaggagagaccaccgacaacagacccgcgctctcacacatacactcacactcgactctttcctctccccccacctcctcctccttccacccccaccactaacaccatctcctcctccttctctctgcaacaagaaaaaaaagccatttacagttgtaacagttggaggataatgcaaaggaagacgctgcctgggaattcaccgtctgtggaaatgagccccagagaggaataaagcagccctcaccttgctctccccacccgaacccactttccccacccgcctcggcccccaccccaacaccaccatcactcccttccctcccccccacctttcccccttttccacccaggtgtcggaccaggcggtccccacttccaccctgcaccccttcttccccccctgcaccatgaacaccaatgtctgcgtggagcccgggccgagcccggaggccccgggcttgcccaaggaaagccacttgcccgagggggctctgaacagccttgtggattacaactcggaaatggagcgctaccgctcctttgccacctccttctacaagaccaacgggggcgccttcccacaggcggccaagatcgcgcgcatcaccacccccatcttccccagcagcgccgccgccgccgcggccgccgcgcgcatcggcatgtccccctggaactgcgacaacgcggccaccgccgccgccgccaccgccatgctctggggcagcggcgggggcgggggcggcggcggggggggtggcggcggcggcggcggcggcggaggcgggggcgggggtggtgggggcggcaggaaatcctcctccgccgccgcctcctcctccgcctcctcctcctcggcgatcctccccgccggcggtggcggcggcggcggcggcggcggcagcaggaccagcatgcaccaccgaaacgactcccagaggctggggaaagctggctgcccgccagagccgtcgttgcaaatggcaaatactaatttcctctccaccttatcccctgaacactgcagacctttggcgggggaatgcatgaacaagctcaaatgcggcgctgctgaagcagagataatgaatctccccgagcgcgtggggactttttccgctatcccggctttagggggcatctcattacctccaggggtcatcgtcatgacagcccttcactcccccgcagcagcctcagcagccgtcacagacagtgcgtttcaaattgccaatctggcagactgcccgcagaatcattcctcctcctcctcgtcctcctcagggggagctggcggagccaacccagccaagaagaagaggaaaaggtgtggggtctgcgtgccctgcaagaggctcatcaactgtggcgtctgcagcagttgcaggaaccgcaaaacgggacaccagatctgcaaatttagaaaatgtgaagagctaaagaaaaaacctggcacttcactagagagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttcaaaaaaaaaaaaaaagaggaaaagaaaagaaaaagacataaaaataatgtgagagcttggagaattggccagtctatttactttcaatacgctgattctttctttgatgtaatttagctatagtagtgaagttgttgtctattttgaaagtggctgtaaaaaataagtttgggtaaacccctgctgtaaaatcatgtatctttgcaaagtacatatctatacttcattttcaaatatatgtgtttcagtactgtaaactgtacagatagcagcttgtattttgtgtgtttagacacaaggagacaatcatgtctgagcatctatggagattaacagtttgtacacaacagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttaggaggggaaaatttataactgacattttttccccagcccaatatgggctgtatacgttttattgtttcttaatttttttcttattttttctgtaggaaaaaatcttaataaaaactaccccaatgttttaacttcatgtatgatattaaatgggtagttttaacacttgaatatgttgagggcttctgccttgaggcagggcttgatatatttttaatttacaaagaattaaacatattcataaaagtgaggcattttatctctttttattttcttttctcatagccacccagttggactagtggtcttcccctggtccttcagtaaaatgctccattgctgccatttccattgttgttacttgatgctttcattcctgagaaggcagggctacagtctctggaatttcataaatgcatgacatacccctccccccacaacctacacacaaaggatctaatgcttcatagaacctgtgctaccttttcatgttggagttggttttcttatcacagtcagggttcttaaggccgtcccatcaggacaaatatttaccttccattttatttctgtttgtcccaattataaagactattttcagtttcaggagtagaacagggtttagcaaaaatatgtagagtatcaaagttacctactgcaactttttgttctttgtccactagccaggtgatttaacccactaaatccattagcttgctgaaaaatgttagcaaagtaaatcacgagaagaaagataatttgagaagagaaatggtatggtacaatgaaagaagctgtaaagattaggaaagactagtaagtgaatatttttaaaaatttagttgtagatttcaatgggatacgataggacagaaaagattttttaaaaagcagaaagagtgtttcatggtgaaagtactgggggagggtggacaaagcatgcacacatgccaatttgaaaatcaagtgtgacttacctcacgtagagtatgaatacatggtccacagttatggtcaacaagcgttttcaagaaaaactcatgatgtgttacacccatccatatttagagatgagaattaaatgattacaagctaaaatgtgctgtatactgtattaattttgagatagctttctacttgatgtatatttctttgagggtttctatctagttagaatttcagcttctgctgtgggaccaatgagagctgtatgagtttttttttttttttccttttccattattttattttttgttttttgtttaccaatttgctaattaattacaagtaagtgaaaacttactttcacacttgaatgataagcttgccttgctctttggaaaatgatgattgttattacagaagtgaaacaaacttctattcaggctacagtaggcatacaataacctaaagatctcatagaagtatactgagagtctaaaatacattctagtagtgcatgtcttggtgtgcttttgtttgtttgctttctaaaagaactaatgaatctgtatattgtaaactgtggtgttttacatgtcaattcatttttttaatgaaagaaaatttgttgattactgaaatgagaaagtgtagcttttcattaattctcttatgttttttattcttgatattgttcttttataccacccactttttaatgtttttggttaaactccatttatataatgtaggatgcatataaagttctcattggtgatgttgaagaaagagatgactcttctggcctttctctagttttcttcctcatatgtccctgtactgagaacttctaaagcttatcattataaacctaaggcagtgatttgaaagtttacatttttcatgattttcaaataccaatgaaatgtaacttttaaatattcctcactgtgtgttttatattcactgtcaagaaaattcagaatgtagattgtgtggacagctatacacaacttaataattatatatcagataaactgaataaaaaactttgtaagagtggtctacgcacacaggatcttgtcctccctaggcgtggatagagagatgccataatctgccagcatttggggagatcatggtaaatacttgaggcgttgatacatagtgcagtgagccaatttccttttcagttgtcactcagcaccataacatcacgaagaacatcattaatgcaaacctctcactaagccttcagaccaaagtggctttctgatggactctgcctgtctgtctacaagtggagtcagattcaaagtagaaatgtatccatccttgggaaagaaaataggaagtcttcccccactgtaggagtatataaaaatgtctcctggttgcttaattcccaacactcaatttccttcttctaaacacatttataaggagcaagagatggtgcacttattatgaattaatattaagcaatcactaaaagaaaggaatattctcttcctttcaatcagaaaccctgatatgtaagttgtgcaattaatgctaaagcatataaagtctttaagctgataagtatctgtaatcaaataatgaaaaaaggaaagcagttaaatgaacacactattcagggtcaaatatgttcagcaaaaagccgtagcgggtctttgatcatggttagattcacagtgatatcaaacagttggttctcatgtaacagctaaatgtttcagtttttttttttttattaaatttggcatttcacactgagatctgtattcctagtgaataaaagacagctactatattaggagggattccattttcacaattgcaaaacagatatttcaggaacatgggccacaaaatgtactcctttcacagtgttctcctcttctgaactgtgcagttatctattaaattttctaatagatatttgtgtaaggtgtatgtatgcttgtgcaattatttaaaaaacggttttggaaaacagtgtatttattaaagaaaattacttatggggcatgtacaaaactgtaaaaaaaaaaaaaaagtaaaaaaaatcacattcaatttgcccagtaaagttgtttttgtgaaatttctgtgttgttgaataaaggactttagtactc

SEQ ID NO: 7116 - DNA, 746 bp, Homo sapiens
ggcagcaggaccagcatgcaccaccgaaacgactcccagaggctggggaaagctggctgcccgccagagccgtcgttgcaaatggcaaatactaatttcctctccaccttatcccctgaacactgcagacctttggcgggggaatgcatgaacaagctcaaatgcggcgctgctgaagcagagataatgaatctccccgagcgcgtggggactttttccgctatcccggctttagggggcatctcattacctccaggggtcatcgtcatgacagcccttcactcccccgcagcagcctcagcagccgtcacagacagtgcgtttcaaattgccaatctggcagactgcccgcagaatcattcctcctcctcctcgtcctcctcagggggagctggcggagccaacccagccaagaagaagaggaaaaggtgtggggtctgcgtgccctgcaagaggctcatcaactgtggcgtctgcagcagttgcaggaaccgcaaaacgggacaccagatctgcaaatttagaaaatgtgaagagctaaagaaaaaacctggcacttcactagagagaacacctgttcccagcgctgaagcattccgatggttcttttaaagcagtagtatatcttattttcaaggcatttggaaatgaagggcaaactaatgtcttgttttaagaaactgcttagtccaccactgaagaaaatatccagaaattattttcattttatgtatagggctttcttc

SEQ ID NO: 7117 - DNA, 2658 bp, Homo sapiens
gttttgccggcagcccccgggcagcgttcatagctcctgcccgggcgggcgcgcggcggcggcggcagaggcggctgagcctgagcggggatgtagaggcggcggcagcagaggcggcactggcggcaagagcagacgcccgagccgagcgagaagagcggcagagccttatcccctgaagccgggccccgcgtcccagccctgcccagcccgcgcccagccatgcgcgccgcctgctgagtccgggcgccgcacgctgagccctccgcccgcgagccgcgctcagctcgggggtgattagttgctttttgttgttttttaatttgggccgcggggagggggaggaggggcaggtgctgcaggctcccccccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaagttctgttcgtttatccattgcgatctggggagccccatctcgatatttccaatcctggctacttttcttagagaaaataagtcctttttttctggccttgctaatggcaacagaagaaagggcttctttgcgtggtcccctgctggtgggggtgggtccccagggggccccctgcggcctgggcccccctgcccacggccagcttcctgctgatgaacatgctgtttgtattgttttaggaaaccaggctgttttgtgaataaaacgaatgcatgtttgtgtcacgaa

SEQ ID NO: 7118 - DNA, 503 bp, Homo sapiens
actgcgttttcttcgcctcgcagaggaaggtcggccttgcacaaatccgcccccacgaatcccaaagaattggagaaaacttccactttgggattatatgcagttgggattatatgagcccggggcttgcaccatggagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccct

SEQ ID NO: 7119 - DNA, 581 bp, Homo sapiens
cccccggggttcggtgcgcggccggggccggagttcgctgcaagtcggcggaaagtttggctgcgcgggttcccccgaagttcagagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctccca

SEQ ID NO: 7120 - DNA, 900 bp, Homo sapiens
gcttagcattccaggccctgggcatctccaagtgccccaggtgggggcactctcctggggtctgtgacagcttgcccccaaccacggagaggtgacaggcacgagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccg

SEQ ID NO: 7121 - DNA, 506 bp, Homo sapiens
attccaggccctgggcatctccaagtgccccaggtgggggcactctcctggggtctgtgacagcttgcccccaaccacggagaggtgacaggcacgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactctt

SEQ ID NO: 7122 - DNA, 777 bp, Homo sapiens
gggcactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacg

SEQ ID NO: 7123 - DNA, 568 bp, Homo sapiens
gcgcacctgagctggggggcgcggccaaattctccctcccggtcctcgaagcttctggccccgctctagagggggcagaaagatagcagatttccccggagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctg

SEQ ID NO: 7124 - DNA, 472 bp, Homo sapiens
cccctccccgcctcgggccagccgcggcggcgcgactcgggctccggacccgggcactgctggcggctggagcggagcgcaccgcggcggtggtgcccagagcggagcgcagctccctgccccgcccctccccctcggcctcgcggcgacggcggcggtggcggcttggacgactcggagagccgagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgcc

SEQ ID NO: 7125 - DNA, 542 bp, Homo sapiens
aaagccttccccaggggccttgtggtgccctccaccctgtcctgagctgccgctgcgggggtggcagatgctgtttcatcggtcgagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcg

SEQ ID NO: 7126 - DNA, 1892 bp, Homo sapiens
gttcggtgcgcggccggggccggagttcgctgcaagtcggcggaaagtttggctgcgcgggttcccccgaagttcagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcataaaaagaaaaagaaaaaaatttaaactgctttttcggaagaacaacaacaaaaaagaggtaaagacgaatctataaagtaccgagacttcctgggcaaagaatggacaatcagtttccttcctgtgtcgatgtcgatgttgtctgtgcaggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcagggagctcacagaaggggagggagcaccaggccagctgagctgcacccacagtcccgagactgggatcccccaccccaacagtgattttggaaaaaaaaatgaaa

SEQ ID NO: 7127 - DNA, 810 bp, Homo sapiens
aggtgggggcactctcctggggtctgtgacagcttgcccccaaccacggagaggtgacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggc

SEQ ID NO: 7128 - DNA, 442 bp, Homo sapiens
acaggatctcactctgtcatccaggctggaatgcagtggcatgattataactcactgcatcctcaacctcctgggctcaagcagtcctcccacctcagcctcctgagtagctaggactacaggcatgtaccaccacacctggttaacttttgtattttttgcagagatagagtttcaccatgttgtccagggtggtctcaaaactcctgagctcaagcgatctgcctgcctctgcttcccaaagtgctgagattacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcc

SEQ ID NO: 7129 - DNA, 558 bp, Homo sapiens
gatttttgccctgggaagagatgggaacagctgaaggagattggcctccgagttcccagccagcccccggaacttgggtagaacccccctacccctcatcctcgcagtagctgggtctctcccagggacgcccctagtcagccttggcctccctctccatgccacctccctttccaagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgc

SEQ ID NO: 7130 - DNA, 878 bp, Homo sapiens
cggggttcggtgcgcggccggggccggagttcgctgcaagtcggcggaaagtttggctgcgcgggttcccccgaagttcagggtcctcttgcctgcccagcttgggctgatggagacagatgtaattatggaattttgcttgggaaattaatttgaaaaagttaattaattggtggttccggaggtggcgggctccacgcccggccagtcttgctgacgtcagtgctgacccactggagacgtgcagcttccgggcaagctgggcagagggaccccggtgacctggctgggcagccctggaacagagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaag

SEQ ID NO: 7131 - DNA, 2627 bp, Homo sapiens
agggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgc

SEQ ID NO: 7132 - DNA, 2867 bp, Homo sapiens
aaaaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgcagtggcgcgatctcggctcactgcagtcttcacctcccagattcaagcgatttccagctaatttttgtatttttagtagagatgggatttcaccatgttggccaagctggacttgaactcctgatctcaagtgatctgcccacctcagcctcccaaagtgctggtattacagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaa

SEQ ID NO: 7133 - DNA, 2746 bp, Homo sapiens
tttttcctgcttcttgaatggtagagagcagtctatagccagagactcgtccctagctcgagctgagctttcgcttgccgtccaccactgcccaccactgtcgtttgctgccatcgcagacctgctgctgacttccatccctctggatccggcaagggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacattttta

SEQ ID NO: 7134 - DNA, 543 bp, Homo sapiens
tttttcctgcttcttgaatggtagagagcagtctatagccagagactcgtccctagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaaga

SEQ ID NO: 7135 - DNA, 589 bp, Homo sapiens
cgagccctgctgcccggggcttgttgcgaattctcagggcccccgcaggcctgggagcggcctgtgataactggtgtatctggcaggagtagcagctgccccttggcgcgactgctggagccgcgaactagagaaacacagacacgcctcatagagcaacagcgtctctcggagcgtggagcccgccaagctcgagctgagctttcgcttgccgtccaccactgcccaccactgtcgtttgctgccatcgcagacctgctgctgacttccatccctctggatccggcaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggac

SEQ ID NO: 7136 - DNA, 2837 bp, Homo sapiens
tggcaggagtagcagctgccccttggcgcgactgctggagccgcgaactagagaaacacagacacgcctcatagagcaacagcgtctctcggagcgtggagcccgccaagctcgagctgagctttcgcttgccgtccaccactgcccaccactgtcgtttgctgccatcgcagacctgctgctgacttccatccctctggatccggcaagggcctggattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgcaa

SEQ ID NO: 7137 - DNA, 405 bp, Homo sapiens
tattagcagcatgaggacagactaatacatagggtgaaacttttgattatatatgtaaatatataaaaatagcctttccactaataagacttctttctcctcagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggacca

SEQ ID NO: 7138 - DNA, 2863 bp, Homo sapiens
aaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgcagtggcgcgatctcggctcactgcagtcttcacctcccagattcaagcgatttccagctaatttttgtatttttagtagagatgggatttcaccatgttggccaagctggacttgaactcctgatctcaagtgatctgcccacctcagcctcccaaagtgctggtattacagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgcactttttaatgtgaacaacagcagcaataaggaccaggaaccagaagaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaagaggagaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagctacttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctggaagagaaagggaagcagattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggacctggagcggaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacaaggcccacaccctctctgagagatactatgattaaaaaagctttatatcttgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacatttttaaaaattagactgcaataaagtaaaattaattatgc

SEQ ID NO: 7139 - DNA, 2834 bp, Homo sapiens
ctggcagataagtgctctggttgtacatggaggatgaccgaaaaaaccaatggtgtgaagagctccccagccaataatcacaaccatcatgcacctcctgccatcaaggccaatggcaaagatgaccacaggacaagcagcaggccacactctgcagctgacgatgacacctcctcagaactgcagaggctggcagacgtggatgccccacagcagggaaggagtggcttccgcaggatagttcgcctggtggggatcatcagagaatgggccaacaagaatttccgagaggaggaacctaggcctgactcattcctcgagcgttttcgtgggcctgaactccagactgtgaccacacaggagggggatggcaaaggcgacaaggatggcgaggacaaaggcaccaagaagaaatttgaactatttgtcttggacccagctggggattggtactactgctggctatttgtcattgccatgcccgtcctttacaactggtgcctgctggtggccagagcctgcttcagtgacctacagaaaggctactacctggtgtggctggtgctggattatgtctcagatgtggtctacattgcggacctcttcatccgattgcgcacaggtttcctggagcaggggctgctggtcaaagataccaagaaactgcgagacaactacatccacaccctgcagttcaagctggatgtggcttccatcatccccactgacctgatctattttgctgtggacatccacagccctgaggtgcgcttcaaccgcctgctgcactttgcccgcatgtttgagttctttgaccggacagagacacgcaccaactaccctaacatcttccgcatcagcaaccttgtcctctacatcttggtcatcatccactggaatgcctgcatctattatgccatctccaaatccataggctttggggtcgacacctgggtttacccaaacatcactgaccctgagtatggctacctggctagggaatacatctattgcctttactggtccacactgactctcactaccattggggagacaccaccccctgtaaaggatgaggagtacctatttgtcatctttgacttcctgattggcgtcctcatctttgccaccatcgtgggaaatgtgggctccatgatctccaacatgaatgccacccgggcagagttccaggctaagatcgatgccgtgaaacactacatgcagttccgaaaggtcagcaaggggatggaagccaaggtcattaggtggtttgactacttgtggaccaataagaagacagtggatgagcgagaaattctcaagaatctgccagccaagctcagggctgagatagccatcaatgtccacttgtccacactcaagaaagtgcgcatcttccatgattgtgaggctggcctgctggtagagctggtactgaaactccgtcctcaggtcttcagtcctggggattacatttgccgcaaaggggacatcggcaaggagatgtacatcattaaggagggcaaactggcagtggtggctgatgatggtgtgactcagtatgctctgctgtcggctggaagctgctttggcgagatcagtatccttaacattaagggcagtaaaatgggcaatcgacgcacagctaatatccgcagcctgggctactcagatctcttctgcttgtccaaggatgatcttatggaagctgtgactgagtaccctgatgccaagaaagtcctagaagagaggggtcgggagatcctcatgaaggagggactgctggatgagaacgaagtggcaaccagcatggaggtcgacgtgcaggagaagctagggcagctggagaccaacatggaaaccttgtacactcgctttggccgcctgctggctgagtacacgggggcccagcagaagctcaagcagcgcatcacagttctggaaaccaagatgaaacagaacaatgaagatgactacctgtctgatgggatgaacagccctgagctggctgctgctgacgagccataagacctggggcccaactgcctctccagcattggccttggccttgatcccagaagctagaggagctatttagatctccggatttacatgcattaccctcatgttccctgaattctcccaaaagcctctctgaccctgggtttttggcctaaacatccaagattccgcctccaagtttagcccaagtttgtggagagtacagactgcgttggctgggcttccgagagcttcggcctgcctaagtctgaggaagggagaagggggcagctgtctgccaggagtctggctcttttgctcatagcgacccctcccttggttctggcccccgctttttctaacatgtcttctgaatgcttcctttttccctgcacacgcatgtacttcgagcaccgactatagacatttagatcaggtacccagtgtctgtctcccacgacaggccaagggatgtgatagtgttgttgggagggggtagaagggtgcccactcagggttattcctcccccatcagatgctccagctcctgctctgtagattgatctgtctgtctgctagccaggatgggatctctgcagtcttctgtggaccaaggagatagacccggcttctggtccattccagggcagggagtgaggagcaaggcaactggcatttgtccacctggagacagaggtagctggcagctctggccatccctcccctatgaagagcattcctaaagaggccctgaaaactgctggtggtggggagactcttcaagttaatatctgcattagaggcacctatgagttaaaaaattcctttgaact

SEQ ID NO: 7140 - DNA, 3470 bp, Homo sapiens
agcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggatttaaaaata

SEQ ID NO: 7141 - DNA, 3841 bp, Homo sapiens
gcttactcatccagtgtggattacactaccagcaaaacatcccaggaaggagtccagggtggccgcccacagttaggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcaggcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaagcgcctggcccctggccaaatgcaacactaacaccagcaacaacacggaggaggagaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcagggttgaattccagctctactcaccctttgaaagctgtgtgactgcctgagagaacctgtttcttcacctaaaaaatgggactttttgtctcagtcccagtgaagtgccaggtttgattgtgaagtccgcatgaaacactgcaccaggcagggctttgcaaagtgcaaggtatccccagtccaagtatatgaaaacgtgcacacaggactctcattacttttttatggaatctgcaaggtgtttttaggctttttaatctgattttcttataaatgaaagattatttagtcacctttctcctgtccaacttcaccaccacctgataatgggtatataacaggaagctgaaggtacaacatagtgactaaaattcagacttacacaagacagtttgaggcatatttcttaatctggtatcacctcgtgtgttctttggggccctagaaaccctggcttttgggagtgctatggcaagtagaagttctgccggatggaaagaggctgccccatttgaggtcatttaaaatctgtgaagcaaatccagactccttgccgttcagccactgtgaaaccagaatctgcttcacagaaaaaagcatctcagttaggagaagagacatcccctccttctcacttgccaaagagattcaaagacagcccctatcctccattcttgagtcagggccctaggtgacctattctaactcaaggaggagagctatgtacagggagagcattttagattgaaggttggaatggtgtactaaaccaaaaaagctgacaactgagagttttagaagattagaccattaggaacgtatctttgcaaactgcccattcacccatgaagaggaagcctcaagatcccttggaattgcatcccaaggcaaagcttttggctcaccgaaagctcacagattgcagaaattagcttttttaaaaaacaaaccccagtaaatataatttcattaacattttataacagatttatatttttgagttccgtgattgcaaattatgacctcaaattccatccttcacttatgtaacatgttgcaaattacccaaagatgagtctttcttctttctttcctttttcctttcttcttcctttccttttttctttcttcttccttctttcttcctttttctctctcctcttttcctcctcaaaatgtatatattttaaaagccttaactgttagttatgcctgcattcatatttgcacaggaaaaataaagacctggattt

SEQ ID NO: 7142 - DNA, 2504 bp, Homo sapiens
aaaacatcccaggaaggagtccagggtggccgcccacagttaggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcaggcaatcatctggggggctaaatgtgacaaaccgagaagatggccaagatcaacacccaatactcccacccctccaggacccacctcaaggtaaagacctcagaccgagatctcaatcgcgctgaaaatggcctcagcagagcccactcgtcaagtgaggagacatcgtcagtgctgcagccggggatcgccatggagaccagaggactggctgactccgggcagggctccttcaccggccaggggatcgccaggctgtcgcgcctcatcttcttgctgcgcaggtgggctgccaggcatgtgcaccaccaggaccagggaccggactcttttcctgatcgtttccgtggagccgagcttaaggaggtgtccagccaagaaagcaatgcccaggcaaatgtgggcagccaggagccagcagacagagggagaaggaagaagacgaaaaagaaggatgcgatcgtggtggacccgtccagcaacctgtactaccgctggctgaccgccatcgccctgcctgtcttctataactggtatctgcttatttgcagggcctgtttcgatgagctgcagtccgagtacctgatgctgtggctggtcctggactactcggcagatgtcctgtatgtcttggatgtgcttgtacgagctcggacaggttttctcgagcaaggcttaatggtcagtgataccaacaggctgtggcagcattacaagacgaccacgcagttcaagctggatgtgttgtccctggtccccaccgacctggcttacttaaaggtgggcacaaactacccagaagtgaggttcaaccgcctactgaagttttcccggctctttgaattctttgaccgcacagagacaaggaccaactaccccaatatgttcaggattgggaacttggtcttgtacattctcatcatcatccactggaatgcctgcatctactttgccatttccaagttcattggttttgggacagactcctgggtctacccaaacatctcaatcccagagcatgggcgcctctccaggaagtacatttacagtctctactggtccaccttgacccttaccaccattggtgagaccccaccccccgtgaaagatgaggagtatctctttgtggtcgtagacttcttggtgggtgttctgatttttgccaccattgtgggcaatgtgggctccatgatctcgaatatgaatgcctcacgggcagagttccaggccaagattgattccatcaagcagtacatgcagttccgcaaggtcaccaaggacttggagacgcgggttatccggtggtttgactacctgtgggccaacaagaagacggtggatgagaaggaggtgctcaagagcctcccagacaagctgaaggctgagatcgccatcaacgtgcacctggacacgctgaagaaggttcgcatcttccaggactgtgaggcagggctgctggtggagctggtgctgaagctgcgacccactgtgttcagccctggggattatatctgcaagaagggagatattgggaaggagatgtacatcatcaacgagggcaagctggccgtggtggctgatgatggggtcacccagttcgtggtcctcagcgatggcagctacttcggggagatcagcattctgaacatcaaggggagcaagtcggggaaccgcaggacggccaacatccgcagcattggctactcagacctgttctgcctctcaaaggacgatctcatggaggccctcaccgagtaccccgaagccaagaaggccctggaggagaaaggacggcagatcctgatgaaagacaacctgatcgatgaggagctggccagggcgggcgcggaccccaaggaccttgaggagaaagtggagcagctggggtcctccctggacaccctgcagaccaggtttgcacgcctcctggctgagtacaacgccacccagatgaagatgaagcagcgtctcagccaactggaaagccaggtgaagggtggtggggacaagcccctggctgatggggaagttcccggggatgctacaaaaacagaggacaaacaacagtgaaaatgcagcatctgtctcctgcttcacagggtcgactgtcagggtgaccgtatgtggccgcagctgtgtggcatggaacttggtcaggg

SEQ ID NO: 7143 - DNA, 4034 bp, Homo sapiens
gagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccgtctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgccggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctgcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtg

SEQ ID NO: 7144 - DNA, 1630 bp, Homo sapiens
ccagctacgagtggcagcaagaaggcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccgcagggtactgacctggctcatgaagggcgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacaggtgctgcctcagacccagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccagggtgatgggagctggaggtctctgaaataagggagaagggaatctgggagagctcagatggacacatggatggaaggaaagaaggatgccctgaagagaagaccttcccgggggaggtggccactgacaccccaccctatttgaacagcgaacccctccctctccacacactcccaggcaggacaaggggagccagagtcacctgcaccagccccagagcctcccagaccagaacaaggggaaggccagccatgggcagcctgcaagatttaggctagacagcaggacttacccccagagggctgtggaaaaggcccatagccgggcgtggtggctcacgcctgtaatcccagcactttgggaggctgaggcaggaggattgcttgagccccgaagttcgagaccaccgtgggcaacacagtgagaccctgtctctaaaaaaccttttttaaattaataaattaaaaagccccatggatggaggactcagtattgagcatctctttgagaggacgcgtgcacagcccccagtgtggtacctggcaccgtcagcacctcgacaggatacagtttttcccagaagaggttctccctaggcctggccacactctctccttccaaggcttggggacaccaatgagcagcaacaaatgttttcattaacattaaaagagtgtaaatgagcacatc

SEQ ID NO: 7145 - DNA, 4347 bp, Homo sapiens
aaggcacagtcataaatacagagggttttcagaaccacctcagagaagatgtttaaatcgctgacaaaagtcaacaaggtgaagcctataggagagaacaatgagaatgaacaaagttctcgtcggaatgaagaaggctctcacccaagtaatcagtctcagcaaaccacagcacaggaagaaaacaaaggtgaagagaaatctctcaaaaccaagtcaactccagtcacgtctgaagagccacacaccaacatacaagacaaactctccaagaaaaattcctctggagatctgaccacaaaccctgaccctcaaaatgcagcagaaccaactggaacagtgccagagcagaaggaaatggaccccgggaaagaaggtccaaacagcccacaaaacaaaccgcctgcagctcctgttataaatgagtatgccgatgcccagctacacaacctggtgaaaagaatgcgtcaaagaacagccctctacaagaaaaagttggtagagggagatctctcctcacccgaagccagcccacaaactgcaaagcccacggctgtaccaccagtaaaagaaagcgatgataagccaacagaacattactacaggctgttgtggttcaaagtcaaaaagatgcctttaacagagtacttaaagcgaattaaacttccaaacagcatagattcatacacagatcgactctatctcctgtggctcttgcttgtcactcttgcctataactggaactgctgttttataccactgcgcctcgtcttcccatatcaaaccgcagacaacatacactactggcttattgcggacatcatatgtgatatcatctacctttatgatatgctatttatccagcccagactccagtttgtaagaggaggagacataatagtggattcaaatgagctaaggaaacactacaggacttctacaaaatttcagttggatgtcgcatcaataataccatttgatatttgctacctcttctttgggtttaatccaatgtttagagcaaataggatgttaaagtacacttcattttttgaatttaatcatcacctagagtctataatggacaaagcatatatctacagagttattcgaacaactggatacttgctgtttattctgcacattaatgcctgtgtttattactgggcttcaaactatgaaggaattggcactactagatgggtgtatgatggggaaggaaacgagtatctgagatgttattattgggcagttcgaactttaattaccattggtggccttccagaaccacaaactttatttgaaattgtttttcaactcttgaattttttttctggagtttttgtgttctccagtttaattggtcagatgagagatgtgattggagcagctacagccaatcagaactacttccgcgcctgcatggatgacaccattgcctacatgaacaattactccattcctaaacttgtgcaaaagcgagttcggacttggtatgaatatacatgggactctcaaagaatgctagatgagtctgatttgcttaagaccctaccaactacggtccagttagccctcgccattgatgtgaacttcagcatcatcagcaaagtcgacttgttcaagggttgtgatacacagatgatttatgacatgttgctaagattgaaatccgttctctatttgcctggtgactttgtctgcaaaaagggagaaattggcaaggaaatgtatatcatcaagcatggagaagtccaagttcttggaggccctgatggtactaaagttctggttactctgaaagctgggtcggtgtttggagaaatcagccttctagcagcaggaggaggaaaccgtcgaactgccaatgtggtggcccacgggtttgccaatcttttaactctagacaaaaagaccctccaagaaattctagtgcattatccagattctgaaaggatcctcatgaagaaagccagagtgcttttaaagcagaaggctaagaccgcagaagcaacccctccaagaaaagatcttgccctcctcttcccaccgaaagaagagacacccaaactgtttaaaactctcctaggaggcacaggaaaagcaagtcttgcaagactactcaaattgaagcgagagcaagcagctcagaagaaagaaaattctgaaggaggagaggaagaaggaaaagaaaatgaagataaacaaaaagaaaatgaagataaacaaaaagaaaatgaagataaaggaaaagaaaatgaagataaagataaaggaagagagccagaagagaagccactggacagacctgaatgtacagcaagtcctattgcagtggaggaagaaccccactcagttagaaggacagttttacccagagggacttctcgtcaatcactcattatcagcatggctccttctgctgagggcggagaagaggttcttactattgaagtcaaagaaaaggctaagcaataaatgtttgattatctttagatgtgatatagctagttcccaaagtgattgtacctaggattgtaacttaaattaacgaggggaaacgacatgctgggacccttgagaaacgaaaggcaaatccctagcttagtttctaggacttatctgagagtgtgatttcatgcagtggtaataagaagattattaaaagccatccctattctccgttttcattaactttatgcaattgctatatcttctaattgtatgtagtaagtttccttttcctttggttctttcctgatgatgtctcttccttccagttttattagcttgctcttggctgtgatgtgattcactaaccttttctcttaatttttattgtgtttaatttcttctttggcactctaaagcctggctaattgttctaggtttatgaatttcacctcttacatgtaaagggtataagattttaatgtaataggtcaaaaatcagattattttcattcaaatgaggatgatgagtcactgtaatatcaaaaaatccccagcagctgggactgaagggaagcagagatcatgaagctttctgaatgagaagtctgatttttggaacagtcccctgaagaccaatgttggtcggcagaattagcaaactggcaaaatcacattgcaggaacatattggaaaaattgtaccctttactaaagaaataaacttcaatattttctcttctaaccaacttaaaagacaccaatctacctaactcatctggctcaagggacttggactggaggatacaggctaaagtgacacttatcagaatcttcctcaagcacttgctggaaaagatatcagattggaacttcttgtttaaaattaagctttagtaaaacaaagtgatgaggttaggaaggcagactctacacatgtcagattgacatatccccacaatttccggaacctacatgtatagctgtttacaaaatctccaagttaattaagggcactttaggaagttgtcctcatgaattagctagcattagcataattaccgacgttgcatgctgtgaggaggctacaaaggccaggctggtgtcggaagtaataatacatatagaattccattctaataaatgccattagtgtataacatcaagttctgtgtaatgaggctatttccaagtctccaaagatggtcactgtaacagcactttgctgagagggttttaacaaatcatattagccaaaaagcctacaacatagatgcatttagcaaaccatgtacaaatcaatcactataataaactgcatcatttgatagagtcaccgtttttgcatgtagtgttagagtatcacaaaatataacaagttttactaaaggatggttggttttttcaggatttaagggaatatggacaaattgttaaatagtatttatttgataaatgggagtttgtatgcagaaagagtgaattgcgtataaaaagggtgatttaaaaacccagaaacaaaaggtagaatagggctgaagcatctgataataggaaaagaaaaggacaaaagtcctcaacttgtgagcaatatgctttccctttacaccctgtaatttattcaaatgatattaaaatacaagaccattgcaatttatgcttttcgcctggcagttattttcccccccaagctatcctgtttcagataatatcaatttatttccaatccatcagactaaaatctaagaaaattcaagaactcttttattgttgatttggtgccaccaaattctttttctttttaaatctttctaattatcctttctttttcaatcccattgctaacacccagaacatattttctgttcaatgcaaataaacattcactttttaccta

SEQ ID NO: 7146 - DNA, 4509 bp, Homo sapiens
aggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 7147 - DNA, 1201 bp, Homo sapiens
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 7148 - DNA, 1201 bp, Homo sapiens
ttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 7149 - DNA, 4693 bp, Homo sapiens
gtggaagcatttccgtcattctgagacagttgggctgaggcggttggtcgcctctctctctctctctctctgttcctcatctacattttgattggtttatttttgtattgttttctttcagtttccgataggtggagaacattctgctaatagcttttcttccagtccatttgtggcttgttaaaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggagataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 7150 - DNA, 1521 bp, Homo sapiens
ttccaggtgtctggaactggattacagtttcttctgattgaacgcagcctttgaatactgcctggcctatcgcgaatacatccctgccttggacaagacgcagctgaatctctaagtgatgctactgccactaccaccccagagctccaaacctgtgcctaagaaatctcagtccagcaaaattgtgcccagtcatcatgacccatctgaaaagacgggggagaattgccaaacgaagatatctccatcttcacttcaggagtctccatcttcacttcagggagcactcaaaaagagatcagcttttgaagatctcactaatgcttctcaatgtcaacctgtccagcccaagaaagaagccaataaagagtttgtaaaagttgtttccaagaagataaacaggaacacacatgctcttggactggccaaaaagaataagcggaatctaaaatgataaccccacgggaagatattgatgaggacagcagtgatccaagtttcaacccaatgtatgccaaggaaatcttcagttacatgaaagagagagaggaacagtttatacttacagattacatgaacaggcagattgaaatcaccagtgacatgagggccattcttgtggactggttggtggaggtgcaggtgtcctttgagatgacccatgagaccctgtacttggcagtgaagctggtggatctctacctaatgaaggcagtatgcaagaaggataagttacaactccttggtgccactgcctttatgattgcagcaaaatttgaggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctaggtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggttcccttcctggagcattacagtggctacagtatctctgagcttcaccccttggtcagacagctgaacaaactgctgactttcagttcttacgatagtctcaaggctgtgtattacaagtattctcacccggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgtt

SEQ ID NO: 7151 - DNA, 1682 bp, Homo sapiens
cggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaa

SEQ ID NO: 7152 - DNA, 1385 bp, Homo sapiens
agtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgct

SEQ ID NO: 7153 - DNA, 2317 bp, Homo sapiens
tcctcccgctgtcccccacggaggggactgctctcccccgctgcatcctttctgtgaggtaccttacccacctcagcacctgagagggtgaaatagaattctaacctcgacattcgggaagtgtttttgagaagtctcggtcggtaagggaagtcttccaagtccgtgcagcactaacgtattggcacctgcctcctcttcggccaccccccagatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgattaaatgagtgcccttccaaagtttctttttaccagaaatacagtggattgagactagaacattgctttcatttgggtttgtaggtttaaaaatctgattctaatcagaagtatatttagaacaaaacactttatttataaaagatgactccaaaattcatcttagtatttcaccatgttatatattattatcagcaagtccttctgaatattatcacagattactccatgtctctaaaatatattggcattgagctcatttgttaggtttgcccaccttattgaacagatttattttccttatacatacttgtgttgtccttggttacgtgtgtccccaaatgtaaataccaaatttttataaatcaaaaattttttagtgtgtaagagattttatgtaattttaagggccttttcagttcatccttttgcaaaaccatcaccacttaattatacttttgcatcagtctagaagactgcatattggaaagcagtgtaaatctataatgatgtatattctggtgagctgaatagggcattatgcatgtcctacaggtctccgccacctctcatgcccatcatcttccttttgtaggtgtaattcataacatatgcctttctgctgtctttaggtataatcagcaacagcagtcattctttgagtgactaatgtatacttggggttggggttgaaattccttaagccaaatgagttttagcttactgttttgaagtgccattttgtattgttaacaagtgtcatgaagggaaggaactaaaatcaaactgacagagtgtcaaggcaacaaaataacataaacaaaataataacattgt

SEQ ID NO: 7154 - DNA, 4442 bp, Homo sapiens
gaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagctctgtaaagggcagctggtggaatttttgaagaaaatggaatctcgaggccccctttcgtgcgacacggttctgaagatcttctaccagacgtgccgcgccgtgcagcacatgcaccggcagaagccgcccatcatccacagggacctcaaggttgagaacttgttgcttagtaaccaagggaccattaagctgtgtgactttggcagtgccacgaccatctcgcactaccctgactacagctggagcgcccagaggcgagccctggtggaggaagagatcacgaggaatacaacaccaatgtatagaacaccagaaatcatagacttgtattccaacttcccgatcggcgagaagcaggatatctgggccctgggctgcatcttgtacctgctgtgcttccggcagcacccttttgaggatggagcgaaacttcgaatagtcaatgggaagtactcgatccccccgcacgacacgcagtacacggtcttccacagcctcatccgcgccatgctgcaggtgaacccggaggagcggctgtccatcgccgaggtggtgcaccagctgcaggagatcgcggccgcccgcaacgtgaaccccaagtctcccatcacagagctcctggagcagaatggaggctacgggagcgccacactgtcccgagggccaccccctcccgtgggccccgctggcagtggctacagtggaggcctggcgctggcggagtacgaccagccgtatggcggcttcctggacattctgcggggtgggacagagcggctcttcaccaacctcaaggacacctcctccaaggtcatccagtccgtcgctaattatgcaaagggtgacctggacatatcttacatcacatccagaattgcagtgatgtcattcccagcagaaggtgtggagtcagcgctcaaaaacaacatcgaagatgtgcggttgttcctggactccaagcacccagggcactatgccgtctacaacctgtccccgaggacctaccggccctccaggttccacaaccgggtctccgagtgtggctgggcagcacggcgggccccacacctgcacaccctgtacaacatctgcaggaacatgcacgcctggctgcggcaggaccacaagaacgtctgcgtcgtgcactgcatggacgggagagccgcgtctgctgtggccgtctgctccttcctgtgcttctgccgtctcttcagcaccgcggaggccgccgtgtacatgttcagcatgaagcgctgcccaccaggcatctggccatcccacaaaaggtacatcgagtacatgtgtgacatggtggcggaggagcccatcacaccccacagcaagcccatcctggtgagggccgtggtcatgacacccgtgccgctgttcagcaagcagaggagcggctgcaggcccttctgcgaggtctacgtgggggacgagcgtgtggccagcacctcccaggagtacgacaagatgcgggactttaagattgaagatggcaaagcggtgattcccctgggcgtcacggtgcaaggagacgtgctcatcgtcatctatcacgcccggtccactctgggcggccggctgcaggccaagatggcatccatgaagatgttccagattcagttccacacggggtttgtgcctcggaacgccaccactgtgaaatttgccaagtatgacctggacgcgtgtgacattcaagaaaaatacccggatttatttcaagtgaacctggaagtggaggtggagcccagggacaggccgagccgggaagccccaccatgggagaactcgagcatgagggggctgaaccccaaaatcctgttttccagccgggaggagcagcaagacattctgtctaagtttgggaagccggagcttccccggcagcctggctccacggctcagtatgatgctggggcagggtccccggaagccgaacccacagactctgactcaccgccaagcagcagcgcggacgccagtcgcttcctgcacacgctggactggcaggaagagaaggaggcagagactggtgcagaaaatgcctcttccaaggagagcgagtctgccctgatggaggacagagacgagagtgaggtgtcagatgaagggggatccccgatctccagcgagggccaggaacccagggccgacccagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatg

SEQ ID NO: 7155 - DNA, 2266 bp, Homo sapiens
atggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggagggtttgcatttgtgtatgaagctcaagatgtggggagtggcagagagtatgcattaaagaggctattatccaatgaagaggaaaagaacagagccatcattcaagaagtttgcttcatgaaaaagctttccggccacccgaacattgtccagttttgttctgcagcgtctataggaaaagaggagtcagacacggggcaggctgagttcctcttgctcacagagccccccggcctggcagcagggctggtgcagcaggacttggtttttgaggtggagacaccggctgtgctgccagagcctgtgccacaggaagacggggtcgacctcctgggcctgcactccgaggtgggcgcagggccagctgtacccccgcaggcctgcaaggccccctccagcaacaccgacctgctcagctgcctccttgggccccctgaggccgcctcccaggggcccccggaggatctgctcagcgaggacccgctgctcctggcaagcccggcccctcccctgagcgtgcagagcaccccaagaggagggccccctgccgctgctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggggatctgccaggagagcccagcaagatgacagcctcgtccagcaacccagacctgctgggaggatgggctgcctggaccgagactgcagcatcggcagtggcccccacgccagccacagaaggccccctcttctctcctggaggtcagccggccccttgtggctctcaggccagctggaccaagtctcagaacccggacccatttgctgaccttggcgacctcagctccggcctccaaggctcaccagctggattccctcctgggggcttcattcccaaaacggccaccacgcccaaaggcagcagctcctggcagacaagtcggccgccagcccagggcgcctcatggccccctcaggccaagccgccccccaaagcctgcacacagccaaggcctaactatgcctcgaacttcagtgtgatcggggcgcgggaggagcggggggtccgcgcacccagctttgctcaaaagccaaaagtctctgagaacgactttgaagatctgttgtccaatcaaggcttctcctccaggtctgacaagaaagggccaaagaccattgcagagatgaggaagcaggacctggctaaagacacggacccactcaagctgaagctcctggactggattgagggcaaggagcggaacatccgggccctgctgtccacgctgcacacagtgctgtgggacggggagagccgctggacgcccgtgggcatggccgacctggtggctccggagcaagtgaagaagcactatcgccgcgcggtgctggctgtgcaccccgacaaggctgcggggcagccgtacgagcagcacgccaagatgatcttcatggagctgaatgacgcctggtcggagtttgagaaccagggctcccggcccctcttctgaggccgcagtggtggtggctgcgcacacagctccacaggttgggagccgtcgtgggacctgggtccccaccgtgaggaccccgtgggcgacagcaggtgtggccagggtggggctccgagccccgggtcaccgcccgcccagcgttccaggcacatgaagagaaagcattccaaagcctctgattgttgtttcctttttctcctcccgaaggaacagctgattcatgctcctcccgcaattgtcacgtctgtgatttatttggtgtttcgggcgtggcctctggagccccggcacgtggtgggccacgctgctggcgctcatgggccctggtgtttgcaccgcactttgtaatcagtcccgtggttgtctgtacagaattaaactattttccgatg

SEQ ID NO: 7156 - DNA, 1204 bp, Homo sapiens
ggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccccctcatcctcctccagggttgggcctgccgccagccagctacccacctcctgccgtcccccctggaggacagcctcctgtgcccccgcccattcccccacccggcatgcctccagttggggggctggggcgggcagcctggatga

SEQ ID NO: 7157 - DNA, 1207 bp, Homo sapiens
ggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcaggcaaggcctctttgaaacacacttgg

SEQ ID NO: 7158 - DNA, 3524 bp, Homo sapiens
gacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggttgtttctcccaaagaagagaacaaagcagcagaaccaccaccacctaaaatccccaaaattgagaccactcatccaccgttgcctccagcccacccacctccagaccggaagcctcccctcgctgctgccttaggtgaggctgagccgccgggccctgtggatgccactgacctccccaaagtccagattccccctccggcccacccggcccctgtgcaccagccaccgccgctgccacaccggcccccgcccccacccccctccagctacatgaccgggatgtccaccaccagctcctacatgtctggagagggctaccagagcctgcagtccatgatgaagaccgagggaccctcctacggtgccctgccccccgcctacggcccacctgcacacctgccctaccacccccatgtctacccgcccaacccgcccccgccacctgtgcctcctcccccagcctccttccccccacctgccatcccaccccctactcctggctaccccccacccccacccacctacaaccccaacttcccacccccacccccacgcctcccgcctacccacgcagtcccccctcatcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaactatccctttctttgttatgggtggaaggtggggctccaggccttcgcagtctgtggcttataaaatgtgcagaggccctccttccagaccctggggacgcgggagaggcctggctgcagctcacagcagccacagccaaccccactgcctcccaaggcactctgggtggatccgcacagctgcctgccaagccagcctgcccccatcctgtgcctgccttggtttcctttggaggacctggttgagttccaaaccagtttgaaactttgaagccttgctgcgtagaacgcacacaggaacccgggggcttggatttgaaaccctttccacttctggcctgtgatgagacagaggcagctggaggagcagcggcctcactgtccaccttgaggggccacggctctgtctgtggaaggggccccgactgagcccccatctgcggtgcttgaggggccttggccctgtctctgcctgctgaccctgccacccacgacagaaacaagcactgagcacccagccaggaggctcacaaagaggcctttatttatctagctcaaagtagacactatcacaatcttgtttgttactccttttactaaaatagttcaaatcaatgtttttaccacactatcaaaaagttctatttcttcttgtctccccacgtcagagtggttgaatagaaggtagaaacaggccgggagtccacgggctcccagctctaaacggcgccagggcaggaaggggtggctccaggtctcactgtggcaccttctacagaaaatagacgtagctgccgggcccggggacagaaaccagacgttccagtccatctccaaaaagcagcacaaatactttgccccacagtatgaaaaatatacacctctaccgctctgcagtcatgcatttagttttaagaaaaaaaaaaaa

SEQ ID NO: 7159 - DNA, 2665 bp, Homo sapiens
ggtccccgacattccatatacaagatggccgcagtcggcaaggagagacgtcgctgaggggcttgcctgaagcgaggggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggtgagtgggctaaagcaggccctgggtagagcaggctttccaggtggcggcaacaccactgttgtttctcccaaagaagagaacaaagcagcagaaccaccaccacctaaaatccccaaaattgagaccactcatccaccgttgcctccagcccacccacctccagaccggaagcctcccctcgctgctgccttaggtgaggctgagccgccgggccctgtggatgccactgacctccccaaagtccagattccccctccggcccacccggcccctgtgcaccagccaccgccgctgccacaccggcccccgcccccacccccctccagctacatgaccgggatgtccaccaccagctcctacatgtctggagagggctaccagagcctgcagtccatgatgaagaccgagggaccctcctacggtgccctgccccccgcctacggcccacctgcacacctgccctaccacccccatgtctacccgcccaacccgcccccgccacctgtgcctcctcccccagcctccttccccccacctgccatcccaccccctactcctggctaccccccacccccacccacctacaaccccaacttcccacccccacccccacgcctcccgcctacccacgcagtcccccctcatcctcctccagggttgggcctgccgccagccagctacccacctcctgccgtcccccctggaggacagcctcctgtgcccccgcccattcccccacccggcatgcctccagttggggggctggggcgggcagcctggatgagataacgtgagccttttttccctctttgtttttttaacaagattttctaatcgacttgcagagtagttgaagtgggtaagcagcagggtaccttgtataatgcacgacagttgcagtatgggaagaatggaccgggcccctgggataaaatcagagtggtcctcacacctagaggacggggacaaccagctttcagagtagcctcatcagtgcccttgcagtctgactgtgtacacttggttcagctaatgtctgagagtcctgcactgggttactttatactagtgaggacgttaaccagccatattggctcaataaatagcttcggtaaggagttaatttccttctagaaatcagtgcctatttttcctggaaactcaattttaaatagtccaattccatctgaagccaagctgttgtcattttcattcggtgacattctctcccatgacacccagaaggggcagaagaaccacatttttcatttatagatgtttgcatcctttgtattaaaattattttgaaggggttgcctcattggatggctttttttttttcctccagggagaaggggagaaatgtacttggaaattaatgtatgtttacatctctttgcaaattcctgtacatagagatatattttttaagtgtgaatgtaacaacatactgtgaattccatcttggttacaaatgagactccttcagtcagttatccaaataaaagcagttctgaaact

SEQ ID NO: 7160 - DNA, 811 bp, Homo sapiens
gatggccgcagtcggcaaggagagacgtcgctgaggggcttgcctgaagcgagggcatggagcttttggagagtgtctttattctgagtgaaagaaaaggaagaggatgaaaaagcaagaacagtttaaaggagctccttctctcatggaccacttccatccacccactccccaaatcacaagatgcacatttggtttacatcagtgaattcagtgatttgtgcagatgtgaattaacccaatcccatgacttgtctaagtgaaagtgcctacatggaataaactgaaaaggggtgctggatggaagagatggttagttttagaacataaatctttgtcaagattaagacaggcccaggttttgctgaagaatggaatctggaccagcgttagaggacctgtatgtctagtgaagaaaaaccagaagaaagattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacacc

SEQ ID NO: 7161 - DNA, 936 bp, Homo sapiens
attccatatacaagatggccgcagtcggcaaggagagacgtcgctgaggggcttgcctgaagcgaggggtgagtgacccaccgactgagggcagcgccgcccacctcccgcgtatctggaggtcggagtaggttatggccaaccgccgctatccactggcggagtctctctttccggattctgcctccctccgctaacctccggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgacaggagcctgttgcctctttctggctgggaaagtagaagaaacaccaaaaaaatgtaaagatatcatcaaaacagctcgtagtttattaaatgatgtacaatttggccagtttggagatgacccaaaggaggaagtaatggttctggagagaatcttactgcagaccatcaagtttgatttacaggtagaacatccataccagttcctactaaaatatgcaaagcaactcaaaggtgataaaaacaaaattcaaaagttggttcaaatggcatggacatttgtaaatgacagtctctgcaccaccttgtcactgcagtgggaaccagagatcatagcagtagcagtgatgtatctcgcaggacgtttgtgcaaatttgaaatacaagaatggacctcc

SEQ ID NO: 7162 - DNA, 1118 bp, Homo sapiens
atagggtccacagccctgtgttcttcaaatactgtaaagcagccctctccagattccttgagggtcactttatattacacattcgtccacacaggacaacaaagtcaccacttccacccgccaaagcgcgctcaggtcggccgccacttcccttggtacacgcggaacgcaagccgcgccgaggctaaaggaagaggccggaatgcagggcgaaggggcgcagagatgctagccaatgctgccacctctattttgggtataagggatcttgtaaagctccgttattcgtgtggctatcacaaacaaggtggtttcgaccggccttggctagagaaggcctcctcagcctctgaggatcccaaggtctgtcgcagcacccaacactcccctcgcaggcccagatgccgagggcggaggcgcggcctggagggactagttggcgcgcggctgcccggcgtggtgacgtcagggcggaagcgcacgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaagcgaccagctacatttaccaaagcctgggtga

SEQ ID NO: 7163 - DNA, 2388 bp, Homo sapiens
acgcggcgtgaagcggcccagaacccggcggtcacgggaatatccgtcgcgccgagaacgctggttagtcttgtttcgggttccggctgcgttgggcttgcgtgcggctcgctaagactatggcgtccgggcctcattcgacagctactgctgccgcagccgcctcatcggccgccccaagcgcgggcggctccagctccgggacgacgaccacgacgacgaccacgacgggagggatcctgatcggcgatcgcctgtactcggaagtttcacttaccatcgaccactctctgattccggaggagaggctctcgcccaccccatccatgcaggatgggctcgacctgcccagtgagacggacttacgcatcctgggctgcgagctcatccaggccgccggcattctcctccggctgccgcaggtggcgatggcaacggggcaggtgttgtttcatcgttttttctactccaaatctttcgtcaaacacagtttcgagattgttgctatggcttgtattaatcttgcatcaaaaatcgaagaagcacctagaagaataagagatgtgattaatgtattccaccacctccgccagttaagaggaaaaaggactccaagccccctgatccttgatcagaactacattaacaccaaaaatcaagttatcaaagcagagaggagggtgctaaaggagttgggattttgtgttcatgtcaagcatcctcataagatcattgttatgtatttacaagtcttagaatgtgaacgtaatcaaaccctggttcaaactgcctggaattacatgaatgacagtcttcgaaccaatgtgtttgttcgatttcaaccagagactatagcatgtgcttgcatctaccttgcagctagagcacttcagattccgttgccaactcgtccccattggtttcttctttttggtactacagaagaggaaatccaggaaatctgcatagaaacacttaggctttataccagaaaaaagccaaactatgaattactggaaaaagaagtagaaaaaagaaaagtagccttacaagaagccaaattaaaagcaaagggattgaatccggatggaactccagccctttcaaccctgggtggattttctccagcctccaagccatcatcaccaagagaagtaaaagctgaagagaaatcaccaatctccattaatgtgaagacagtcaaaaaagaacctgaggatagacaacaggcttccaaaagcccttacaatggtgtaagaaaagacagcaagagaagtagaaatagcagaagtgcaagtcgatcgaggtcaagaacacgatcacgttctagatcacatactccaagaagacactataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaaa

SEQ ID NO: 7164 - DNA, 2305 bp, Homo sapiens
cacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcagga

SEQ ID NO: 7165 - DNA, 1186 bp, Homo sapiens
ggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgt

SEQ ID NO: 7166 - DNA, 3229 bp, Homo sapiens
atgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgttctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttattggggtatgtgaggagcagtaaatataaaaccagttcaactgtcctcatggaatcaccctttctgtttttgcagtattcataaagctagtgtaaggtctggttttagtctattaaatcttagagatctaaaggaaatgctcaaaatgtagccaggttttaaatgctttaacttttaaaaaatgtaaatttttgtatgtttatagcttctaaatatgaaagttaaagaatgtactgtgatgaaatgttcagtattatgttgcttctcagtatcatgttgcttctcagtattgtgttgcttctgattctatgaatgttcattttaagaccccttgttgaaatgggacagttggcagcggctctgatgagcccgagaagaggcctgcccttgggtgcggagtctccctccgcacgatgctcccacgcgtccaacttgcacccaaggggcttttccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagctttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagagggcccaagcccggggcctgttgcctgggggcacacaggtgctggatggtacctcggggttctctcctgcccccaagctgggtgctgggattacagcctggagtgcagtggcgctatctgggatcactgcaagctccgcctaccagattctggtgattcttgtgcctcagcctcccaagtagctgggattgcaggcgcccaccaccacgctcagagtctcgctgtgttgccagtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatac

SEQ ID NO: 7167 - DNA, 5959 bp, Homo sapiens
acttttggagtaggaggccatgctgcaaacccagacttttcaggctgcatctcagatataccgaagtgtgtacccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgggggagaatggcaccggcgactgggctccgcggctcgtgttcatcgaggagcccccgggcggtggcggcgtggcccccagcgcggtccccactcgccccccgggaccgcagcgctgcagggagcagagcgactgggcatcggacgtggaagtcctggggcccttgcgtcccgggggcgtggcaggctcggccctggtccaggtgcgagtgcgggagctgcgcaagggcgaagcggagcggggcggcgcgggcggtggcgggaagctcttttcactctgcgcctgggatgggcgcgcgtggcaccaccacggcgccgccggcggcttcctgctgcgcgttcgcccgcggttgtacggcccaggcggggacctgctgccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagttgtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaaccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctccccccgcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagaagccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctggaa

SEQ ID NO: 7168 - DNA, 5305 bp, Homo sapiens
atggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccgcgctgcagggagcagagcgactgggcatcggacgtggaagtcctggggcccttgcgtcccgggggcgtggcaggctcggccctggtccagctcttttcactctgcgcctgggatgggcgcgcgtggcaccaccacggcgccgccggcggcttcctgctgcgcgttcgcccgcggttgtacggcccaggcggggacctgctgccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagttgtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaaccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctccccccgcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagaagccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctgg

SEQ ID NO: 7169 - DNA, 2399 bp, Homo sapiens
aagctcttttcactctgcgcctgggatgggcgcgcgtggcaccaccacggcgccgccggcggcttcctgctgcgcgttcgcccgcggttgtacggcccaggcggggacctgctgccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagttgtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctgcctgtctctgtgtctcgtaccttcgctgtcagcagaggggactctctggcaggctccccagtaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactg

SEQ ID NO: 7170 - DNA, 5455 bp, Homo sapiens
atggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccgcgctgcagggagcagagcgactgggcatcggacgtggaagtcctggggcccttgcgtcccgggggcgtggcaggctcggccctggtccagctcttttcactctgcgcctgggatgggcgcgcgtggcaccaccacggcgccgccggcggcttcctgctgcgcgttcgcccgcggttgtacggcccaggcggggacctgctgccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccctacagtgacctggtgaaggaggagctcaacatcatacagggtgccctggagctgcgcaccaaagttgtggaggaggtgctgacccccctgggagactgcttcatgctgcgctcagacgcggtgctcgacttcgccactgtctccgagatcctgcgcagcggctacactcgcatcccagtgtacgagggtgaccagcggcacaacattgtggacattttatttgtcaaggacttggccttcgtggaccccgacgactgcaccccgctcctcactgtcacccgcttctacaaccggcccctgcattgtgttttcaatgacacccgactggacacggttctggaggagtttaagaagggaaaatctcacctggccattgtccagcgggtgaataatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttgggggagaatccaccctcccatcatctgcttcccccaaggcctcccacaggtgacagaatgttctgccttcccttccatctcttcacccctagctgtcagtttggcagattttccctcgttacctccagttcgactcagaaccttgacatggccataacagaaggaggtgcctctgatagaacatgctagaaatggtcttttccacagcatagtctgggactggaaaagagatgtctgactgcaagctgacaatgccactctgggacccctgatgctcttctttgttctttgggtcccctgatgccataggagacctatcgtcttggaacttgccattctttcctccagaacaaaatgttaactttctaacacatttcatgcatagcttggctcagaaggtgccattggcagacaggcacatgggaggctggagtaggaggtctgaagattagttcaggggatggaccaagaatttcccccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaaccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctccccccgcaaaaaaaaaaaagaaagaaagaaagagaaaagaaaagaaaagcaaccacagccagccttagggaaaacttggaagtaagtgaaatttgtcttcagaataactatctccctttctgatctgtctcctactctttagatgttctcagtcaagtactcactgaactcattgatcgagtgctgtctgctaaatctccaaaccattcccaaacctttccccgtagtataccatccagcttccctccccttcctccaaaaccctccctcccacctccccacacccattgagtcattcacaggcaggagggagactgatcattcctctgggttatctgcatctcaaaagaaaatgcttacccacaggaactgttaactcaggggttcttaacttggggtccatcaccccagggggtccatagttggacttcagagggtctatgaaacccctaaaactgtcagtatttaatgtatttattcttgtatgttttttccagagcattaaagctttcataaggttctcaaaggtctcagacctacaaagagttaaaacaaacagacaaacaaaaaaaaacactactattttaaatagtggaactttcagcccagcgtttctgcaatgcagagtgaagtggatactgggcagttcgagacaggtttttaatcataagtggtcttttcaaatgtccatcaattgatggggaaggctggcacccaccaagaagtggaagtcctcagaaattctcggcacaccctagagtattgtacaaccaacacccccacataactttgtcccctcttccccaacaacccagagcaggtgttgcagacaggagggccacagcgtgtggaagtaaagactttggagctagagaagccttttccagcaatgattattgacttcaccacaccccttgcctggcctggcctgaggctcagcagtgcatgacttctcgtagataacttcacagtcatccagtcccaacacctgctcttgcctggtaggaacaggcgaagtgtcagccctcaatgttgggtacttagacccaaaccaataaatggtgagttttgaacaagaactaccatcatgcaggcttcttgcccagctgaccactggccccggggtgcctgcctggctggtcttcatcacctgaggccaccaggctcaagccactgctgttgcattacacccatccctttgcaaaatccctatggagcctgtcaccactcccctccctatatacccccaccccacaaagattttcttcaggttaaaaaaaaagtttaaaaaaaagattttaaaataaagcatttatgaaggcttaataaattgtaaataatttttaaataaaatgaaaatgcctttcctgg

SEQ ID NO: 7171 - DNA, 2207 bp, Homo sapiens
aatgagggagaaggggaccctttctatgaggtgatgggcattgtcacgctggaggatatcatagaggagattatcaagtcggagatcctggatgaaactgatctctacactgacaatcggaaaaagcagagggtcccgcaacgggagcggaagcggcatgacttctccttgtttaagctttcggacacggagatgcgggtgaagatctcaccacagcttctgctagccacacaccgcttcatggccacagaagtggagccctttaagtctctgtacctttcggagaagatcctgctccggctcctgaaacatcccaacgtgatccaggagctgaagtttgatgagaagaacaagaaggccccggaacactacctctaccagcgcaaccgccctgtggactactttgtgctgcttctacagggtaaagtggaggtggaggttggtaaggaaggccttcgctttgaaaatggagcctttacttactatggcgtcccagccatcatgaccactgcttgctcagataatgacgtgcggaaggttggaagtctggctggatcttctgtctttctaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaagatcacacggcagcaatatcagaacgcactcactgcctgccacatggacagctcacctcagtcccctgacatggaggccttcacagacggggactccactaaggcccccacaacccggggcacaccccagacccctaaggatgaccccgccatcacgctcctcaacaacaggaacagcctgccgtgcagccgctcagacgggctgagaagccccagcgaggtagtgtacctgaggatggaggagctggccttcacccaggaagaaatgactgacttcgaggagcacagcacacagcagctcacgctgtctcctgcagccgttcccacgagagcagcatcagatagtgaatgttgtaacatcaacctggatacagagaccagcccctgcagtagcgattttgaggaaaacgtgggcaagaagctgctgagaaccttgagtggccaaaaaaggaagaggtcaccagaaggagagagaacctctgaggacaactccaatttaacacctctgatcacatgacagggcaaagccagcattcactgggtgtgtgaaattccagagctttaaagaagtgggactcagccatgttggcgcgtgattgacattacagcacagaaaactgttagtgactggtttcctgttagataagggttccagcagcctggggcagtatgtctcagctggaatggaaagaatgtgagatggaacctcaagtcactgtttttaccagggacacatctgttttggctcccaatcagcagtcttcaatcgatcaataattctgctctggaagagaaggaacagggagcagagagacccaactgggagccagagatggaacttcaggtcttaagtgcaaatcaaagcaaaaaacaaacaaaacttacatggaaaaactgtaagtgctgaaagcaagtttagccatgacaaaccaaagagtgcccaggtcagccaagaaagatacataatctcatgggacttcagtgggagttacacaggaatgttgaagaatcattcttctttttcatgcatttgtccttctcccacccccttactacaccctagcagatcagctgagtgtactttattccaagaacttactggatctctggtttttctcctgaagttggggcaggtgcaattccaagcataaccaccagatggcagagtgaccgcgcatacctgcttccaagaataaaacagttctgaaaagcaaccgcaaagccgggcgcggtggctcacacctgtaatcccaacagtttggaagaccgaggcgggtggatcacttgaagtcaggagtttgagaccagcctggccaacatggtgaaaccccatctctcctgggcatgtagtcccagctactcgggaggctgaggcaggagaatcgcttgaacctgggaggcagaggttgcagtgagctgagatcacaccactgcacttcatcctaggcaacagagcgagactctgtctccccccgc

SEQ ID NO: 7172 - DNA, 3987 bp, Homo sapiens
agtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaacc

SEQ ID NO: 7173 - DNA, 2059 bp, Homo sapiens
gcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaagaacacacaaacaagaaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggccaccatggtgaaaccccgtttctaataaaaatacagaaaaatta

SEQ ID NO: 7174 - DNA, 4053 bp, Homo sapiens
agtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccagttcctttgtccctgtctcgtacctttgttgtcagcagaacagagttgttagcagcaggttctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaacc

SEQ ID NO: 7175 - DNA, 3903 bp, Homo sapiens
cgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccttgtgtttatatctatagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggc

SEQ ID NO: 7176 - DNA, 4205 bp, Homo sapiens
cgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccttgtgtttatatctatagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccagttcctttgtccctgtctcgtacctttgttgtcagcagaacagagttgttagcagcaggttctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaa

SEQ ID NO: 7177 - DNA, 1849 bp, Homo sapiens
agtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaagaacacacaaacaagaaacccaaatcataccaacactgcaacgaacagaactgtgtgacgcacagtaaggccaaccacagcctgcacaacgaaggcgccatctag

SEQ ID NO: 7178 - DNA, 3447 bp, Homo sapiens
gcgagaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgagggaagtcccacctggccatcgtgcagaaggtgaacaacgagggtgaaggcgaccccttctacgaggtcctgggcctggtcaccctggaggacgtgatcgaggagatcatcaggtccgagatcctggacgagtctgaagactaccgagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaa

SEQ ID NO: 7179 - DNA, 3308 bp, Homo sapiens
gctgcgcgagaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaa

SEQ ID NO: 7180 - DNA, 2073 bp, Homo sapiens
gcgcgagaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcctgggtggccccggagggggcgggctgccgggaggaggcggcctcccccgcgggcgagtggcgcgcgctgctgcgcttgcgcctgcgggccgaggccgtgcgcccgcactcggcgctgctggcggtgcgcgtggagccgggtggcggggcggctgaggaggcggcgccgccctgggctctgggcctgggggcggccgggctgctggcgctggcagcgctggcgcgaggcctgcagctgagcgcgctggcgctggcgcctgccgaggtgcaggtgctgcgcgagagcggctcggaggcggagcgtgcggcggcgcggcgtttggagcccgcgcggcgctgggccggctgcgccttgggcgcgctgctgctgctggccagcctggcgcaggcggcgctggcggtgctgctgtaccgcgcggccggccagcgtgcggtgcccgccgtgttgggcagcgcggggctcgtgttcctggtgggagaggtggtgccggccgccgtgagcgggcgctggacgctggcgctggcgccgcgagcgctcggcctcagccgcctggccgtcctgctcactctgcccgtcgcgctgcccgtggggcagctgctggagctggcggcgcggcccgggcggctgcgggagcgggtgctggagctggcgcgcggcggcggcgacccctacagcgatctcagcaagggcgtgctgcgctgccggaccgtggaggacgtgctcacgcccctcgaagactgcttcatgctggacgccagcaccgtgctggacttcggcgtcctggccagcatcatgcagagcggccacacgcgcatcccggtgtacgaggaggagcgctccaacatcgtggacatgctctacctcaaggacttggccttcgtggatcccgaagactgcacgccgctcagcaccatcactcgtttctacaaccatccgctccacttcgtcttcaacgacaccaagctggacgctgtcctggaggaattcaagcgaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccagccttccccttctcccccggggcagggacagtgcggcatattcagattcagacctctttgggctgagccaccttgtgagtgcagttactgcctttgtgtggccgtga

SEQ ID NO: 7181 - DNA, 4800 bp, Homo sapiens
agttggctcggcggcagcggagcggccggagctgcggtgcggaccggggccgcgcggcgtggcgcggggagcggcggcggcggcagagccagagcaacatggcgccggtgggcgggggcgggcgcccggtcggcggaccggcccgcgggcgcctcctcctggcggcgccggtgctgctggtgctgctgtgggcgctgggggcccggggccagggcagcccccagcagggcacgatcgtgggcatgaggctggcgagctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacccggtgcactttgtcttccatgacaccaagttggatgccatgctggaggagttcaagaaggggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtagtactgtactaagagctctgccctcatgtgaattcctgccctggcgcctcttccctggggctgaatcaggccctgctgcaaaactccaggcttcccagggttggggaggctgtgggaccaaggtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaa

SEQ ID NO: 7182 - DNA, 1591 bp, Homo sapiens
agcttaatcctgcgggagcttgggtgaagggaggaaagagcagagaatcgccaagaaatcagggtgctcagctatctgcaggtgtggacccagggcccaagcctgtggcttccagtcagtccagcccgcacctctcccatgggagggcctgagagcgcgggaacatcctgggcccctgggatctcagaggctggaccttcctgggagactcattgagtaagatgcagaggactccttcttgggtggtgggagtccctggtctgctctggggcccctggcttttccccatgagaaaaagcagctggagctgggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgctcatcgcttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagcctcaatcctggccctgtttctccaggcctggtgatagggtctgcctcccagcccctccctccatgaactcatcccttcctcatgcagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccaccctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagta

SEQ ID NO: 7183 - DNA, 6917 bp, Homo sapiens
aatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctataaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtattttcagaaccaaagcaaagggtggtttgttcactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgagtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagacagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagcattgccactttagtagtttgtttgatttgcctattgtttaataatgagtacattcttattaagtgatgagtacattcttaattttaaggtatgtttttttcaagcagcttcattttattaggaaaaatacatactcatttgttgtaaacagtgattgtggggtttcattttctgaatgtactcaaaactcccaacaacaattgaacaggatgtttgctaatagaaaatctaaaacaggaatatgtgtatatggcatgaattagtcattgactttaagcttcttatccatacaaggaactaataaaatgtttattgacaacataaa

SEQ ID NO: 7184 - DNA, 4491 bp, Homo sapiens
aatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcattttta

SEQ ID NO: 7185 - DNA, 2363 bp, Homo sapiens
gtgaatgaaggagcgggcggaggaggaagtgtcatggcgtcgggccgtggagcttcttctcgctggttctttactcgggaacagctggagaacacgccgagccgccgctgcggagtggaggcggataaagagctctcgtgccgccagcaggcggccaacctcatccaggagatgggacagcgtctcaatgtctctcagcttacaataaacactgcgattgtttatatgcacaggttttatatgcaccattctttcaccaaattcaacaaaaatataatatcgtctactgcattatttttggctgcaaaagtggaagaacaggctcgaaaacttgaacatgttatcaaagtagcacatgcttgtcttcatcctctagagccactgctggatactaaatgtgatgcttaccttcaacagactcaagaactggttatacttgaaaccataatgctacaaactctaggttttgagatcaccattgaacacccacacacagatgtggtgaaatgtacccagttagtaagagatctttgggggatagcaagaaacatttgagtgaatgttgttgaagattttcagtagtatagaaaatgatggcgctcttgtgatatttcaagcaaggatttggcacagacatcctatttcatggctaccaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatgagctaacacatgagtttctacaaatattggagaaaacgcctaataggttgaagaagattcgaaactggagggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaaga

SEQ ID NO: 7186 - DNA, 3948 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattggg

SEQ ID NO: 7187 - DNA, 3873 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattggg

SEQ ID NO: 7188 - DNA, 3960 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatata

SEQ ID NO: 7189 - DNA, 3940 bp, Homo sapiens
aggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatata

SEQ ID NO: 7190 - DNA, 1380 bp, Homo sapiens
caggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacggacgtgagagaaaaacgcaagagtctcttcattaaccatggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttt

SEQ ID NO: 7191 - DNA, 1245 bp, Homo sapiens
gcaccgcgccgcgaggagtccgggggctgcgcccacgcccgctgcccgcccgctcgtcggctagtcccgccgtccggcgcggacacgcgtgcccccggcttgaaccggaacctcttgccgaggcggccgccgtcgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaa

SEQ ID NO: 7192 - DNA, 3344 bp, Homo sapiens
gttgtatgccacataagtaaccaaatttgcttgtcaattatgtcttttttttttcttttttctgagacagagtcttgctctgtggcccaggctggagtgcagtggtacagtcttggctcactgcaacctctgcctcccaggttcaagcgattctcatacctcagcctccagagtagctggactgcaggcgcatgctaccacggccagataatttttgtatttttaatagagacggggtttcttttttttttttttccctgacagagttttgcttttgttgcccaggcttggagtgcaatggcgcgatcttggctcactgcaacctccacttcctgggttcaagcaattcttctgcctcagcctcccaagtagctgggattacaggtgtacaccaccatgcctggctaattttgcatttttttagtagagacatggtttcaccatgttgatcagggtcgtctcaaactcctgacctcaagtgatccacccgcctcagtctcccaaagttttgggattataaatgtgcgccactgcacccggtcaagacagggttttgccatgttagccagggaggtctcaaactcctgacctcaagttatccgccctgcttggtctcccaaagtgctgggattgcacacatgagccactgtgcctggcctcaattatgtctttaactgtggctgttctaagacttttgtcatccacaattgttgttttacttttatcctttcacagagcagtttataatcagctatagaactctgaggtactcttcaatctaagtttctgatcacttttgagattgtgccattggaatagagcaaaaaacttccaagactctcattgagagctgctatattcatgaggattgttcatccaatattgggcaaaatgagagttaattttatggactaaactaatataagactgaaataatctttttatgtttttgcttaaaacattactgattctttctgttctttcagaaccaagaaaacttttttttttttttttttgagacagaatctcactctgtcgcccaggctggagtgcagtggcgccatctcggctcactgcaagctccgcctcccaggttcacaccattctcctgcttcagcctcccaagtagctgggactacaggcgcccaccaccgcgcccggctaattttttgtatttttagtagagacagggtttcaccgtgttagccaggatggtctcaatctcctgaccttgtgatccgcccacctcggcctcccagagtgctgggattacaggcgtgagccacggtgcccggctggtaacttttttaactttgagctatttgcagcttttagcaattgagtaaagtacactcctgtgaggaagatttggaacatatttctgttttcttttttgttttttatattttgcttgggtagcatatttctttctgatttctccaaaaattgggaactatctgtgagcactatttaaaaaaaaaaaaaaaacttttccctctcccttcccctatttgtattctaatgtcaatataatgatgtgtgcacgtgcagtaacaatctgttttctcttgtaataggacatagagacactgcatattttaccaaggctttgactggaatggcatgctttcaaatataaacagacggctttaaggaatcagagttgacctatagtgcccatcaaagcccttgggaaaactggcttcatactgtatccacccagtggattcttcttgcccagatggagcccatgtatcaagatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacag

SEQ ID NO: 7193 - DNA, 1780 bp, Homo sapiens
aagagaggcggggccagcgctcggcatggcggagccagatctggagtgcgagcagatccgtctgaagtgtattcgtaaggagggcttcttcacggtgcctccggaacacaggctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctaccctgtgagccggagctcatgccgacctttccccaccaccgcaacaagcgggccgccccagccacctccgagggccagagcaagcgctgtaaaccctgacggtgggcctggcacacgcctgtattcccacaccaggtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactccagatgaggacaagagggacaaggtatggggtgggagccacaattgaggataccccgagactaccaggagagccctgggctggaggctgagctgcatccctgctccccacatggaggacccaacaggaggccgtggctctgatgctgagcgaagctataggctcttgttggataaaagcttttttaacagacatggtttca

SEQ ID NO: 7194 - DNA, 1424 bp, Homo sapiens
gtctgcgcctgcgcgcaagagaggcggggccagcgctcggcatggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggatggacaaggagaaggatggcatccccatcagcagcttgcgggagatcacgctgctgctccgcctgcgtcatccgaacatcgtggagctgaaggaggtggttgtggggaaccacctggagagcatcttcctggtgatgggttactgtgagcaggacctggccagcctcctggagaatatgccaacacccttctcggaggctcaggtcaagtgcatcgtgctgcaggtgctccggggcctccagtatctgcacaggaacttcattatccacagggacctgaaggtttccaacttgctcatgaccgacaagggttgtgtgaagacagcggatttcggcctggcccgggcctatggtgtcccagtaaagccaatgacccccaaggtggtcactctctggtaccgagcccctgaactgctgttgggaaccaccacgcagaccaccagcatcgacatgtgggctgtgggctgcatactggccgagctgctggcgcacaggcctcttctccccggcacttccgagatccaccagatcgacttgatcgtgcagctgctgggcacgcccagtgagaacatctggccgggcttttccaagctgccactggtcggccagtacagcctccggaagcagccctacaacaacctgaagcacaagttcccatggctgtcggaggccgggctgcgcctgctgcacttcctgttcatgtacgaccctaagaaaagggcgacggccggggactgcctggagagctcctatttcaaggagaagcccctacgtcttccgatcagtggtgtctgtgaagggtgccgcgagccaggctgaccaggcgcccgggatccagctcatccccttggctgggaacatcctccactgacttcctcccactgtctgccctgaacccactgctgcccccagaaaaaggccgggtgacaccggggggctcccagcccgtgcaccctggaagggcaggtctggcggctccatccgtggctgcaggggtctcatgtggtcctcctcgctatgttggaaatgtgcaaccactgcttcttgggaggagtggtgggtgcagtccccccgctgtctttgagttgtggtggacgctggcctgggatgagagggcccagaagaccttcgtatcccctctcagtcgcccggggctgtcccgtgcatgggttggctgtggggaccccaggtgggcctggcaggactcc

SEQ ID NO: 7195 - DNA, 1021 bp, Homo sapiens
tctggcgagcgccggttgctgtttcttctcaggctcagggaccggccgcggccccgtaggggtgaggcagtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcggtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctga

SEQ ID NO: 7196 - DNA, 2751 bp, Homo sapiens
acacaggaagtgaggatacttctggcgagcgccggttgctgtttcttctcaggctcagggaccggccgcggccccgtaggggtgagttccgactgggctgttttaactcaaatgggtgatgaaaaggactcttggaaagtgaaaactttagatgaaattcttcaggaaaagaaacgaaggaaggaacaagaggagaaagcagagataaaacgcttaaaaaatgtaagccatatttttttaagtaagtggttttcttaaaggagatttaatttctttgccctcatttttccattagaacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatggggagaactcagccgggaccacaggcgtggctactgcggctggagctgcgatgagactcggaactcctcgtcttactttgtgctccatgttttgtttttgtattttggtttgtaaatttgtagaattaaatcattttccttgttgtggaggaaa

SEQ ID NO: 7197 - DNA, 2446 bp, Homo sapiens
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggggaatgatggcgtgtgcctcttcagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7198 - DNA, 2419 bp, Homo sapiens
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7199 - DNA, 2473 bp, Homo sapiens
tctggcgagcgccggttgctgtttcttctcaggctcagggaccggccgcggccccgtaggggtgaggcagtgttttaactcaaatgggtgatgaaaaggactcttggaaagtgaaaactttagatgaaattcttcaggaaaagaaacgaaggaaggaacaagaggagaaagcagagataaaacgcttaaaaaataacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctga

SEQ ID NO: 7200 - DNA, 2458 bp, Homo sapiens
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagttaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7201 - DNA, 1255 bp, Homo sapiens
gaggatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagagaaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacaggtg

SEQ ID NO: 7202 - DNA, 2527 bp, Homo sapiens
acacaggaagtgaggatacttctggcgagcgccggttgctgtttcttctcaggctcagggaccggccgcggccccgtaggggtgagttccgactgggctgttttaactcaaatgggtgatgaaaaggactcttggaaagtgaaaactttagatgaaattcttcaggaaaagaaacgaaggaaggaacaagaggagaaagcagagataaaacgcttaaaaaataacaacgcttcttcggtgaagttcttttgtacttccaaatgtcgcagtctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7203 - DNA, 450 bp, Homo sapiens
gccgcggccccgtaggggtgagttccgactgggcggaccaggtgtgggagcgcgacgagaactgcgcaccgaggtctttcttccgagcaggcctcggagcggggcggacccgggcccgggggcgagcgacaccctcgcttccgcggacagtctcatcccgcacggaactttgggtggtggaggcggcgggtccaaacgctgtctggagccaacgtctgccaggctgaacctcaagtgtgcgggactgaacccgaggaaatagcccagtgcccgggtcaggtggccttgttcgcgagcacatctcggagcatctccccggtctcaagtgttttaactcaaatgggtgatgaaaaggactcttggaaagtgaaaactttagatgaaattcttcaggaaaagaaacgaaggaaggaacaagaggagaaagcagagataaaacgcttaaaaaat

SEQ ID NO: 7204 - DNA, 2449 bp, Homo sapiens
gatacttctggcgagcgccggttgctgtttcttctcaggctcagggaccggccgcggccccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgttgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7205 - DNA, 700 bp, Homo sapiens
gactgaacccgaggaaatagcccagtgcccgggtcaggtggccttgttcgcgagcacatctcggagcatctccccggtctcaaggtgcagctgtccagtgtgctagtggcttcacgtagtccaagcggtctttctagcagattctgacagtaaaagcagtgtttgatgagtggcaggtcctgagttaagagcctttaaacggatgatctttaatccgcgatcgatactatcactgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatggaagcatgctagagtgaaagaaagagagcacgaacgtcggaaacgacatcgagaagaacaggataaagctcgccgggaatgggaaagacagaagagaagggaaatggcaagggagcattccaggagag

SEQ ID NO: 7206 - DNA, 2306 bp, Homo sapiens
gtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccgggattccaagcgggattcccttgaggagggggagctgagagatcactgcatggagatcacaataaggaactccccgtatagaagagaagactcaatggaagacagaggagaagaagatgattctttggccatcaaaccaccccagcaaatgtctcggaaagaaaaagttcatcacagaaaagatgaaaagagaaaagaaaaatgtaggcatcatagccattcagcagaaggggggaagcatgctagagtgaaagaaagagagcacgaacgtcggaaacgacatcgagaagaacaggataaagctcgccgggaatgggaaagacagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgcagggaagtgtctgcacatcaccgaacgatgagagaggactacagcgacaaagtgaaagccagccactggagtcgcagcccgcctcggccgccgcgggagcggttcgagttgggagacggccggaagccaggtgaggccaggccggcgcctgcgcagaagccagcacagttaaaagaagagaaaatggaagaaagggacctgctgtccgacttacaggacatcagcgacagcgagaggaagaccagctcggccgagtcctcgtcagcggaatcaggctcaggttctgaggaagaagaggaggaggaggaagaggaggaggaggaagggagcaccagtgaagaatcagaggaggaggaggaggaagaggaagaggaggaggaggagaccggcagcaactctgaggaggcatcagagcagtctgccgaagaagtaagtgaggaagaaatgagtgaagatgaagaacgagaaaatgaaaaccacctcttggttgttccagagtcacggttcgaccgagattccggggagagtgaagaagcagaggaagaagtggggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtccctgagggagatcaacaccatcctcaaggcccagcatcccaacattgtcaccgttagagagattgtggtgggcagcaacatggacaagatctacatcgtgatgaactacgtggagcacgacctcaagagcctgatggagaccatgaaacagcccttcctgccaggggaggtgaagaccctgatgatccagctgctgcggggggtgaaacacctgcacgacaactggatcctgcaccgtgacctcaagacgtccaacctgctgctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatcttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgcaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcagcagcgtgtgaagcggggcaccagcccgaggccccctgagggaggcctgggctacagccagctgggtgacgacgacctgaaggagacgggcttccaccttaccaccacgaaccagggggcctctgccgcgggccccggcttcagcctcaagttctgaaggtcagagtggaccccgtcatgggg

SEQ ID NO: 7207 - DNA, 955 bp, Homo sapiens
gcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttggggtcttctggccagagcttgtcaccagccccatggcctctccaggcgtgctcatgcccacaacccgcggccagccccacgtggtgctgctcagccttctctgcccctcctgggaatctgtcattcgtgggtgcttcagagtaaaatcaatgagtttctgagcagaa

SEQ ID NO: 7208 - DNA, 845 bp, Homo sapiens
agcctagcccgcaggcccctcgcagcctctgcgagctgctcgggagacagttttgccgagcctccgttttttcacatgtgcagtgacagatgaacgggacgatatacgcaaatgagtgtcagcagatccgacatccaaattcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtg

SEQ ID NO: 7209 - DNA, 572 bp, Homo sapiens
ggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccag

SEQ ID NO: 7210 - DNA, 2346 bp, Homo sapiens
gcaaatgcgtttccggtggggtgggcggggcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaataaagacaagatagaactagacagcagcagcccagcctcgaaggaaaatgaagaaaaggtgtgtctggaatataacgaggaactggagaagctgtgtgaggaactgcaggccaccttggatgggttgaccaaaatacaggtgaaaatggaaaagctgtcttcaactaccaagggaatttgtgaactagaaaactaccattatggggaggagagtaaacgaccccctctgttccacacgtggcctacaacccatttctatgaggtttcgcataagctcttggagatgtacaggaaggagctgctcctgaagcgcacggtggccaaggagcttgcccacaccggggatcccgacctcaccctgagctacctgtccatgtggctgcaccagccctatgtggagagcgacagcaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagaccttggggtcttctggccagagcttgtcaccagccccatggcctctccaggcgtgctcatgcccacaacccgcggccagccccacgtggtgctgctcagccttctctgcccctcctgggaatctgtcattcgtgggtgcttcagagtaaaatcaatgagtttctgagcagaatgagatcccaggagggcactcatggtggtttatgggactctggactcctgagaagcggccttgagtctacaggatacatctacagcctgacctgaccacccaacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcaggaggccgaggcaggaggatcgcttaagcctgggagttaaaggctgcaatgagctatgattgcaccactgcactccagcctgggcaacagagtgaaaactcatctctaaaaaaaaaaatcaggccggggccgggcacagtggctcacgcctgtaatcccagcactttgggaggccgaggcaggcagatcacgaggtcaagagatcgagaccatcctggccaacatggtgaaacctcatctctactaaaaatacaaaaattagccgggtgtggtggcggacacctgtagtcccagctactcggcaggctgaggcaggagaatcacttgaacccaggaagcggagggtgcagtgagccgagattgcaccattgcacttcagcctggcgacagcaagactccatctcaaaaaaaaacaatcaggcccagtgcagtggctcacacctataatcccagcactttgggatgctgaggcgcgtagatcacctgaggtcaggagttcaagatcagcctgaccaccatggagataccccgtctctactaaaaatacaaaatgatccaggtgtgatggcacatgcctgtaatcccagctacttgggaggctgaggcaggagaattgcttgaaccctgtggtggaggttgcggtgagccaagatcgagccattgcactccagcttgggcaacaagaccaaaactccatctc

SEQ ID NO: 7211 - DNA, 1158 bp, Homo sapiens
ccacatggaagctggaggagcaacgggagcgctgggcgtggggtgcaaattgcccggtgccttctgtttcccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgccc

SEQ ID NO: 7212 - DNA, 1568 bp, Homo sapiens
gcccttcctggccgccatgtgtacccagagcctgggactggctgggctgggcagtgacccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaataaataaacgtggtatgttcctg

SEQ ID NO: 7213 - DNA, 1758 bp, Homo sapiens
actaaaatccagcctcgaaggggcacagctgttctcccagccctgcggtcagctgttccctgtgaggtcatcatcgctcacaggcattccccagtcaattctggggtcactaggtggcttggggagaggtggaaacccgtgctgaggtcgtcaagaggccgttgggaacacaatgccaccaaccaggtcagcgctgggccgccagtgcccgggatctaggccgccaaaccccaaacccctaaccgagagcgctccgcccccatttccgctgcattctggaacgcgtagtcccggagcggcccttttcaagagggctgggagcacataaaaggaataacaacagcggggcacactgggaaccacggcgccgcggcggggcgcccggaaaacggacacgcgttgcttcctgggacttgaagtccaaggtttgcctccgcggtagaaacggagccctggagtcgagtgctgcagagagcgtgagcgcagacggctgggggttgtagtcttcttgtcctcggtctcgggcattgcggggagacctagtcgttttaggactacaagccccagaaggccctgcgcgggcagacggggcggggctggaggctcaggtgccgcctcctctgcaacgccggggccagagtcttaaaaccgagggcccgcaggggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagtcattcctcttccagctactaaaagggctgggattctgtcatagccgcaatgtgctacacagggacctgaagccccagaacctgctaataaacaggaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctaggccccgggacccccggcctccaggctggggcctggcctatttaagccccctcttgagaggggtgagacagtgggggtgcctggtgcgctgtgctccagcagtgctgggcccagccggggtggggtgcctgagcccgaatttctcactccctttgtggactttatttaatttcataaattggctcctttcccacagtc

SEQ ID NO: 7214 - DNA, 783 bp, Homo sapiens
atgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgagattgtaaagaatggggagctgaaattggctgattttggcctggctcgagcctttgggattcccgtccgctgttactcagctgaggtggtcacactgtggtaccgcccaccggatgtcctctttggggccaagctgtactccacgtccatcgacatgtggtcagccggctgcatctttgcagagctggccaatgctgggcggcctctttttcccggcaatgatgtcgatgaccagttgaagaggatcttccgactgctggggacgcccaccgaggagcagtggccctctatgaccaagctgccagactataagccctatccgatgtacccggccacaacatccctggtgaacgtcgtgcccaaactcaatgccacagggagggatctgctgcagaaccttctgaagtgtaaccctgtccagcgtatctcagcagaagaggccctgcagcacccctacttctccgacttctgtccgccctag

SEQ ID NO: 7215 - DNA, 2500 bp, Homo sapiens
agctcaggattagagcagcggagccgcctagcagccaccttcccccgccagtccgcgcgcccgggccggggctaggccccccaccgccgggtcccccggggctgcagtagcagcggcgccgcccgcggctcccgctggggcctgggcgccggccccgctctgcaggatgggcacagtgctgtctctttcgcctgcctcctcggccaagggccggaggcccggcgggctgcccgaggagaagaagaaggcgccgcccgcgggggacgaggcgctggggggctacggggcgccgccagtgggcaagggcggcaaaggcgagagccgactcaagcggccgtccgtgctcatctcggcgctcacctggaagcgcctggtggccgcgtccgccaagaagaagaaaggcagcaagaaggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctcccccttcccttcagcccattccccctcggttttatccatttccttgcctcctttttgtgtcttcatttttcctcctgtctgcattcctctctctctctctccctctctctcctgttcctctctttcttcctccctctccctgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcaccatcttccctcctgtctgccttcttcctccacttgtgtcagcttgcatttttttattcctgactgagtcaccacacccctctcccctgatcaaagggaatattagtttttaatttggatcgactgaggtgccaggagaaactgcagtcccaggtatccagacagccaccaggatggtccctcgccccacccccaccgcctctccccaccttttccaacgtgttgcatgctgggagctggggggtgtgggggaaggggctgccggcttctttcaggaggctgaggtttggaggcaaaatcaacctgggagaccaccccggccgcggcgcctcagtggacaggtgggaggaaaagaaaacttcttaccttggaggagggacatcccgcttccttatccttagcttttttgttgctcctccccactgccccttttaatttatttggttgtttgcggagggaggggggaggggggtaggctgggccgggaactgtccgaggtgctgagctggggcgggaccggaatcctcccggtagggtaccagggactgagttgggcctggggccgtgtccaaggtgccaatgatgcgggccgacagagcgggccgcactgtctgtctgtccgtctgtcccggaaagaactataaagcgctggaagcgcctgc

SEQ ID NO: 7216 - DNA, 2127 bp, Homo sapiens
ggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctact

SEQ ID NO: 7217 - DNA, 1619 bp, Homo sapiens
ggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcc

SEQ ID NO: 7218 - DNA, 1417 bp, Homo sapiens
gaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagtttattcccttatctctgctgtctgcctgctgtcctattttcacaaatatttgctctcagctaactatcaggtacgtctttatcagcggcatgaagacagaccaatacagtgaattggtaccagtagagtggggcattgctgaaaagatacccaaaaatgtggaagcaactttggaactgggtaacaggcagaggtttgaacagtttggagagctcagaagaagacaggaaaatgtgggaaagtttggaactttctagagacttgttgaatggctttgacc

SEQ ID NO: 7219 - DNA, 2160 bp, Homo sapiens
ctacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagaatacaggaaatgcacaaactgaaaggaagaagaacttgccagatgtagagtagaaaatgcagcagctgaaaattcagggaatcccagaatcactgtatggttttttaaaaatcctttttattaatgttacatacacaaaaatgctaactagataattttacaggtatatcgtaaatcctgttagttatatgtacattcacctaaatttgtttttaaatttattaatctttaaattattcatgttttcttaatttgaacatgaatttataaaaactacctgactggtacatcctaataaaattgcagcttacatttagtcatataa

SEQ ID NO: 7220 - DNA, 1501 bp, Homo sapiens
atggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcca

SEQ ID NO: 7221 - DNA, 1405 bp, Homo sapiens
agaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaaagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagaggtacgtctttatcagcggcatgaagacagaccaatacagtgaattggtaccagtagagtggggcattgctgaaaagatacccaaaaatgtggaagcaactttggaactgggtaacaggcagaggtttgaacagtttggagagctcagaagaagacaggaaaatgtgggaaagtttggaactttctagagacttgttgaatggctttgaccagaagcttgatcatgatatggacaataaaatccaagctgaggtggtctcagatagagatgaggaacttgttgggaactggagcaaaggtgactcttgttatgttttagc

SEQ ID NO: 7222 - DNA, 3459 bp, Homo sapiens
acctcaggactctttagagctctgagtgagtggggtgggggagttggaggaggaagaccctacaggaagttgagctgtactctccaacaggcgagcacatggtcgtctcctctctcccttcagggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaacca

SEQ ID NO: 7223 - DNA, 3453 bp, Homo sapiens
gagggcggggccggaggtttcgattagttgtctctgccgctggggaaggtaaagcggcgacggcgtcctcaggagctgtggggtcccctgctagaagtgggggactcggcgggggagtcatttaatacttcatgattagaacaaatatgtgaaagttcccaccaaccagtgagaatttcttccttcagacggttttggatcttactgcacagctttctgagaagttcttttggtgccatgttttgtggcttgcatcaaaagaggagtttgtcttcatgaagattcctaacattggtaatgtgatgaataaatttgagatccttggggttgtaggtgaaggagcctatggagttgtacttaaatgcagacacaaggaaacacatgaaattgtggcgatcaagaaattcaaggacagtgaagaaaatgaagaagtcaaagaaacgactttacgagagcttaaaatgcttcggactctcaagcaggaaaacattgtggagttgaaggaagcatttcgtcggaggggaaagttgtacttggtgtttgagtatgttgaaaaaaatatgctcgaattgctggaagaaatgccaaatggagttccacctgagaaagtaaaaagctacatctatcagctaatcaaggctattcactggtgccataagaatgatattgtccatcgagatataaaaccagaaaatctcttaatcagccacaatgatgtcctaaaactgtgtgactttggttttgctcgtaatctgtcagaaggcaataatgctaattacacagagtacgttgccaccagatggtatcggtccccagaactcttacttggcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccggtttccagctgttaaccatcctcagtccttggaaagaagataccttggaattttgaatagtgttctacttgacctaatgaagaatttactgaagttggacccagctgacagatacttgacagaacagtgtttgaatcaccctacatttcaaacccagagacttctggatcgttctccttcaaggtcagcaaaaagaaaaccttaccatgtggaaagcagcacattgtctaatagaaaccaagccggcaaaagtactgctttgcagtctcaccacagatctaacagcaaggacatccagaacctgagtgtaggcctgccccgggctgacgaaggtctccctgccaatgaaagcttcctaaatggaaaccttgctggagctagtcttagtccactgcacaccaaaacctaccaagcaagcagccagcctgggtctaccagcaaagatctcaccaacaacaacataccacaccttcttagcccaaaagaagccaagtcaaaaacagagtttgattttaatattgacccaaagccttcagaaggcccagggacaaagtacctcaagtcaaacagcagatctcagcagaaccgccactcattcatggaaagctctcaaagcaaagctgggacactgcagcccaatgaaaagcagagtcggcatagctatattgacacaattccccagtcctctaggagtccctcctacaggaccaaggccaaaagccatggggcactgagtgactccaagtctgtgagcaacctttctgaagccagggcccaaattgcggagcccagtaccagtaggtacttcccatctagctgcttagacttgaattctcccaccagcccaacccccaccagacacagtgacacgagaactttgctcagcccttctggaagaaataaccgaaatgagggaacgctggactcacgtcgaaccacaaccagacattctaagacgatggaggaattgaagctgccggagcacatggacagtagccattcccattcactgtctgcacctcacgaatctttttcttatggactgggctacaccagccccttttcttcccagcaacgtcctcataggcattctatgtatgtgacccgtgacaaagtgagagccaagggcttggatggaagcttgagcatagggcaagggatggcagctagagccaacagcctgcaactcttgtcaccccagcctggagaacagctccctccagagatgactgtggcaagatcttcggtcaaagagacctccagagaaggcacctcttccttccatacacgccagaagtctgagggtggagtgtatcatgacccacactctgatgatggcacagcccccaaagaaaatagacacctatacaatgatcctgtgccaaggagagttggtagcttttacagagtgccatctccacgtccagacaattctttccatgaaaataatgtgtcaactagagtttcttctctaccatcagagagcagttctggaaccaaccactcaaaaagacaaccagcattcgatccatggaaaagtcctgaaaatattagtcattcagagcaactcaaggaaaaagagaagcaaggatttttcaggtcaatgaaaaagaaaaagaagaaatctcaaacagtacccaattccgacagccctgatcttctgacgttgcagaaatccattcattctgctagcactccaagcagcagaccaaaggagtggcgccccgagaagatctcagatctgcagacccaaagccagccattaaaatcactgcgcaagttgttacatctctcttcggcctcaaatcacccggcttcctcagatccccgcttccagcccttaacagctcaacaaaccaaaaattccttctcagaaattcggattcaccccctgagccaggcctctggcgggagcagcaacatccggcaggaacccgcaccgaagggcaggccagccctccagctgccagacggtggatgtgatggcagaagacagagacaccattctggaccccaagatagacgcttcatgttaaggacgacagaacaacaaggagaatacttctgctgtggtgacccaaagaagcctcacactccgtgcgtcccaaaccgagcccttcatcgtccaatctccagtcctgctccctatccagtactccaggtccgaggcacttccatgtgcccgacactccaggtccgaggcactgatgctttcagctgcccaacccagcaatccgggttctctttcttcgtgagacacgttatgagggaagccctgattcacagggcccaggtaaaccaagctgcgctcctgacataccatgagaatgcggcactgacgggcaagtgacttctgcaagcctgcggctggtcccaatgccctgaatcacctctctcatggaagaaccaattaacaccaatgaatcaaccattaa

SEQ ID NO: 7224 - DNA, 2106 bp, Homo sapiens
actatgctcaagtccaggcaacgtacaggcaggggaaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgcctgaagcaccgtggattcataagctgctttaaagaacaactgagcacttggtttcacagaatggccttaccacagtaagcaccacctactctcaaatgagcatttctacctctgtggaactgaaataaaaacaagtcttccatga

SEQ ID NO: 7225 - DNA, 1995 bp, Homo sapiens
ggcaacgtacaggcaggggaaatgtctcttccaaggttgctaaaagtaaacatcagaacatatgataattccattccaatcagtgaatcaagcagaaaatcatggaatcaaaaacactttgctttgacatttcccaaaccactccagagaggtacaaatgataaatcaagacctttgaaatcacaaataacagttactagacatgacaaaagaaaactagaagaaggccagaaaccagctcataaatggataaggcattctttcagaaaaattttgcaatggccacccatttacacagctgccagggaacagactccattcagacatctttatacttccaaaacccatcttaaaaaagcagaatataaaaagtccaaagatgaaaaaggaggaacacctttgaagaaagattccaagaaaaaaggaggttcatatgcaacaaatccagaatccaagcaaatagtagaagagaaaactaaaagacaaaatgaggcagataaaactcccttaaaatcatcacatgaaaatgaacaatccaagaagtcaaaatccagttcagaaactaatccagaatcccaaaattctaagacagtctcaaaaaattgttcacaaaaagataagaaagattcaaagaattccaagaagacaaacactgaattcctacatacaaagaacaatccaaagaaagatttgaagaggtcaaagactagtaatgatcccatatcagagatttgctcagaaaatagtttaaatgttgatttcctcatgttagtgggacagtctgatgatgaatccataaattttgatgcatggttaaggaattactcacagaataattcaaagaattattctttgaagtatacaaagtatacaaagaaggacacaaaaaagaatgcaaagaaaagctctgatgctgaatctgaagactcaaaggatgctaagaaagattcaaagaaagttaagaaaaatgtcaagaaagatgacaagaaaaaggatgtaaagaaggacacagagtctactgatgctgaatctggagactcaaaggatgaaaggaaagatacaaagaaggataagaaaaaattaaagaaagatgacaagaaaaaggacacaaagaagtacccagagtctactgatactgaatcaggagatgcaaaggatgcaagaaatgattcaagaaatttgaagaaagcttcaaagaatgatgacaagaaaaaggatgcaaagaaaattacattctctactgattctgaatctgaactggagtcaaaggagagtcagaaagatgaaaaaaaggataaaaaagattcaaagacagataataaaaagtctgtcaagaatgatgaagagtctactgatgctgactctgaaccgaagggagattcaaaaaagggtaaaaaggatgaaaagaaggggaagaaagattcaaagaaagatgacaaaaagaaggatgcaaagaaaaatgcagaatctactgaaatggaatctgatttggagttaaagaaggacaagaaacactcaaaggaaaagaaaggttcaaagaaagatatcaagaaggatgcaagaaaggacacagagtctactgatgctgaatttgatgaatcttccaagacaggctttaaaacatctacaaaaatcaaaggttcagatactgaatctgaagagtcactatataaacctggggctaagaagaaaattgatgaatcagatggcacatctgcaaattcaaagatggaaggactggaatcaaagagaggattcagaatgtcatccaaaaagactacattcaatgaaaaaggggaaaaagcaagtacaggtagagttcctccatcaagagaaaaaccaccactccctgcttgtgagccttctctaccatcaccaaaggtcagacgtctttgttggtgcaagatgcctcctccacctccaaaaccaagatatgctcctttgattcaaagaagacagcgtttaggagtcagaagatgtcaactacttatgtga

SEQ ID NO: 7226 - DNA, 1196 bp, Homo sapiens
ttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgag

SEQ ID NO: 7227 - DNA, 1805 bp, Homo sapiens
ctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacactta

SEQ ID NO: 7228 - DNA, 2044 bp, Homo sapiens
tcgtgagactgcagacccgctaataaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagctagtattccagagctgctattagaagctgcttcctgtgaagatcaaatcttcctgagtaattaaatggaccaacaatgagcctttgcaaaattttcaagcggaaattttaaggcacctcattatctttcataactgtaattttcttagggatcatctctgttaaaaagttttctgtatgtcatgttataattacaggtcaattctgttaatatctttttgttaattttgctctatgtttgcctctgaaggaggtgagatttgtgctactttgggagattatgttcttttttcatgtctaagatttattttgatcatgtttataatataatggtaattcatttttgatgttttgtgaagaatttaaatttaaacgaatgttcttaaatcaagtgtgatttttttgcatatcattgaaaagaacattaaaagcaatggtttacacttagttaccataagccgaaaatcaaatacttgaaaagtttactgtgaaattctactgatttaagactatacttaatatttttaaaaaaataaatcagctgggcgcggtggctcacgcatgtaatgccagcacttttggaggataaggcgggcggatcacgaggtcaggagattgagaccatcctggctagcgcagtgaaacccccatctctactaaaaatgcaaaaaaaattagacggacgtggtggcgggtgcctgtagtcccagctacttgggaggctgagg

SEQ ID NO: 7229 - DNA, 2583 bp, Homo sapiens
tcccgggcccgcgacacacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 7230 - DNA, 2353 bp, Homo sapiens
cacgccctcggggtcggtcctcgaggacgcgcagggccccccacccaccaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 7231 - DNA, 2453 bp, Homo sapiens
ccgtctccgcctcgccgcagtcggggcagccgctcgcccctcttttccatgtatccgtccagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 7232 - DNA, 2605 bp, Homo sapiens
gtgctctgccacgagacattggccggcgccggcctccgcccccgcctctccgccaatcaccgcccgcctgctcccctcgccgtgggtccccgcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacacaa

SEQ ID NO: 7233 - DNA, 2554 bp, Homo sapiens
gcgaggccgccaccccggggtcgccgtctccgcctcgccgcagtcggggcagccgctcgcccctcttttccatgtatccgtccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtcgcaggaccaggcctgggcaggcgtggtgggggggcctgcagaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctgggtggctcagcatcctccacgggctgcgccgtctgctcggggctgagctggcgggagcagtttgcgtgtttgggttttttaattgagatgaaattcaaataacctaaaaatcaatcacttgaaagtgaacaatcagcggcatttagtacatccagaaagttgtgtaggcaccacctctgtcacgttctggaacattctgtcatcaccccgtgaagcaatcatttcccctcccgtcttcctcctcccctggcaactgctgatcgactttgtgtctctgttgtctaaaataggttttccctgttctggacatttcatataaatggaatcacac

SEQ ID NO: 7234 - DNA, 819 bp, Homo sapiens
agttcctgccagtggacatttaattctaattcacgtctcactccctcccctactgtgagccccacgtggcagagaccgcggcggagctgcgcgggccggaggaggctgcggagcatcgctctgacctgagccggggacgctgcggaggcgcagcacgttcctctgcccagagctgatgggcaccgtccgtgtctttcgctgcaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacactcggcgaaggggagcctggagaaggggtccccagaggataaggaagccaaggagcccctgtggatccggcccgatgctccgagcaggtgcacctggcagctgggccggcctgcctccgagtccccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaag

SEQ ID NO: 7235 - DNA, 2129 bp, Homo sapiens
ggagctgcgcgggccggaggaggctgcggagcatcgctctgacctgagccggggacgctgcggaggcgcagcacgttcctctgcccagagctgatgggcaccgtccgtgtctttcgctgcagggcaagaagttaaccaagtaaaacagcatcggaacaccaggatcccatgacagattctgttgtcacgtctccttacagagtttgagcggtgctgaactgtcagcaccatctgtccggtcccagcatgccttctgagaccccccaggcagaagtggggcccacaggctgcccccaccgctcagggccacatcaccacactgccccggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattttctctaatgtaacttcctcttaggatgtttcaccaaggaaatattgagagagaagtcggccaggtaggatgaacacaggcaatgactgcgcagagtggattaaaggcaaaagagagaagagtccaggaaggggcggggagaagcctg

SEQ ID NO: 7236 - DNA, 1703 bp, Homo sapiens
gctaagcgctctgggcctggccctgatcacctctgcaaacttctcagggcaaaatctccaaaaatcttgccagatattctgaagaaaatcggggacacccctatggtcagaatcaacaagattgggaagaagttcggcctgaagtgtgagctcttggccaagtgtgagttcttcaacgcgggcgggagcgtgaaggaccgcatcagcctgcggatgattgaggatgctgagcgcgacgggacgctgaagcccggggacacgattatcgagccgacatccgggaacaccgggatcgggctggccctggctgcggcagtgaggggctatcgctgcatcatcgtgatgccagagaagatgagctccgagaaggtggacgtgctgcgggcactgggggctgagattgtgaggacgcccaccaatgccaggttcgactccccggagtcacacgtgggggtggcctggcggctgaagaacgaaatccccaattctcacatcctagaccagtaccgcaacgccagcaaccccctggctcactacgacaccaccgctgatgagatcctgcagcagtgtgatgggaagctggacatgctggtggcttcagtgggcacgggcggcaccatcacgggcattgccaggaagctgaaggagaagtgtcctggatgcaggatcattggggtggatcccgaagggtccatcctcgcagagccggaggagctgaaccagacggagcagacaacctacgaggtggaagggatcggctacgacttcatccccacggtgctggacaggacggtggtggacaagtggttcaagagcaacgatgaggaggcgttcacctttgcccgcatgctgatcgcgcaagaggggctgctgtgcggtggcagtgctggcagcacggtggcggtggccgtgaaggccgcgcaggagctgcaggagggccagcgctgcgtggtcattctgcccgactcagtgcggaactacatgaccaagttcctgagcgacaggtggatgctgcagaagggctttctgaaggaggaggacctcacggagaagaagccctggtggtggcacctccgtgttcaggagctgggcctgtcagccccgctgaccgtgctcccgaccatcacctgtgggcacaccatcgagatcctccgggagaagggcttcgaccaggcgcccgtggtggatgaggcgggggtaatcctgggaatggtgacgcttgggaacatgctctcgtccctgcttgccgggaaggtgcagccgtcagaccaagttggcaaagtcatctacaagcagttcaaacagatccgcctcacggacacgctgggcaggctctcgcacatcctggagatggaccacttcgccctggtggtgcacgagcagatccagtaccacagcaccgggaagtccagtcagcggcagatggtgttcggggtggtcaccgccattgacttgctgaacttcgtggccgcccaggagcgggaccagaagtgaagtccggagcgctgggcggtgcggagcgggcccgccacccttgcccacttctccttcgctttcctgagccctaaacacacgcgtgattggtaactgcctggcctggcaccgttatccctgcacacggcacagagcatccgtctcccctcgttaacacatggcttcctaaatggccctgtttacggcctatgagatgaaatatgtgattt

SEQ ID NO: 7237 - DNA, 461 bp, Homo sapiens
ctgaggagtacagagaacactcttcctgttcctctgcagctgaaggatgatggctgagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaa

SEQ ID NO: 7238 - DNA, 554 bp, Homo sapiens
gagaacactcttcctgttcctctgcagctgaaggatgatggctgagccctggcaggccctacagctcctgttggccattctattgactctgatggccctcccctaccaagcaaggaagaaaacctttctaagcgtccatgaagtgatggcagtagaaaactatgcgaaggacagcttgcagtggatcaccgaccagtataacaaggaaagtgatgacaagtaccacttcaggatcttccgagtccttaaagtccagaggcaggtcactgaccacctggagtatcacctgaatgtggaaatgcagtggaccacctgccaaaagccagagaccacgaactgtgtcccccaggaaagggagcttcacaagcaagtcaactgcttcttctcagtgtttgctgtaccctggtttgaacagtacaaaattttgaacaaaagctgcagcagtgactaggtgtcctggagtgtacaactgcggccactgcatgtgagagaatcctgcaatgggcaataatccttaatataggcaataaatgtttgtcaacatattctcttaa

SEQ ID NO: 7239 - DNA, 751 bp, Homo sapiens
gttcactttggttccagcatcctgtccagcaaagaagcaatcagccaaaatgatacctggaggcttatctgaggccaaacccgccactccagaaatccaggagattgttgataaggttaaaccacagcttgaagaaaaaacaaatgagacttacggaaaattggaagctgtgcagtataaaactcaagttgttgctggaacaaattactacattaaggtacgagcaggtgataataaatatatgcacttgaaagtattcaaaagtcttcccggacaaaatgaggacttggtacttactggataccaggttgacaaaaacaaggatgacgagctgacgggcttttagcagcatgtacccaaagtgttctgattccttcaactggctactgagtcatgatccttgctgataaatataaccatcaataaagaagcattcttttccaaagaaattatttcttcaattatttctcatttattgtattaagcagaaattaccttttctttctcaaaatcagtgttattgctttagagtataaactccatataaattgatggcaattggaaatcttataaaaactagtcaagcctaatgcaactggctaaaggatagtaccaccctcacccccaccataggcaggctggatcgtggactatcaattcaccagcctccttgttccctgtggctgctgataacccaacattccatctctaccctcatacttcaaaattaaatcaagtattttacaaagtg

SEQ ID NO: 7240 - DNA, 2163 bp, Homo sapiens
cgcgtcccttcttgcggggccaccgcgaccccgcaggggactccgaagccaaagtgcctcctccccgccccttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgggctgtgccccttggggtggaaggggcaggattctgcagctgcttttgcatttctcttcctaaatttcattgtgttgatttctttccttcccaataggtgatcttaattactttcagaatattttcaaaatagatatatttttaaaatccttacagattgcctcctttgttttagacttttttcttcgtctgaaccaccccgggcaggtccttcccctcgggggcatggagggcggagagactgcctggctcacacagcaagcaggtggtggacccaggattcacacctgcccactccggcccgcgttcctaaccaccactctttacatgttggtgctttgactcttaggtcctggccccaagcttcagtttctcccataaaataaaagagtgtgagtaaatccaattccagagcataactggctccagatctcagatacattcacgcactttatgctctggtacggagaggcagccacacagtgtcgtgcacgtgcagaatagcctgcagcctcactgagtgccctgtggtgcgggaggcttcccatggagccacgtgggcttctaaagggaggtatcttaggagagcgtggctgtttttaaaaacaccttctagttttcaacagggattacttcccattcatggaattggtccggtgccttcccaactgtgattctatgttaaataggacagaagagggagcatcatacatgataagagctaagactgggggtgaaagtctctgtgcaccggggtcatgatgtgaacgtgttcctgagggtgtcctgagctgcgctttgcctccgaggcgtccggcagcgtatgccagaactgcagctgcagggttcaggctgtccagatcgtgggggatctgtgaagactaaggagggatctaccagtgagtccacagagctttgaaagtgatgttaggaaattctgaatcaggccgggcgcggtggctcacacctagaatcccaacactttgggaggccaaggtgggtggatcactctgaggtcaggagttctaggccagcctgacccacatggtgaaaccctgtctctactaataataaaaaaattagctgggcgttgtggcaggcgcctgtaatcccagctacttgggaggctgagacgggaggatcacttggactcgggaggtggtgggtgcagtgagccgagatcgtacctctgcactccagcctgggtgggtgacagagtgagatcctatctcaaaaaaaaaccaaaaagaaaactgaatcatggactgtgtgtattctacactcttaacatgaactctgagactaagcttttataacatgcaaaacagaatcaagcagttttgcattgaaaggaaaacccgttgtatttcccacttgagaatttccagcggaaggcaggtgggggaggggctgtttaggggaccacgcagcgggagagccatccccaacaggaagggagcggttgtctgcaggagcagtgaccaggaactcctatggggcacctgggttgggggaagctggatttagggttagaagcttgtgtgtaaacaggaaatatcagtgtaaaacagaaaataaaatatgtaattaa

SEQ ID NO: 7241 - DNA, 873 bp, Homo sapiens
gcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctga

SEQ ID NO: 7242 - DNA, 832 bp, Homo sapiens
ggaaagggacagaggagaaggagcctgaagagtggcggcatggaggggcccgaagtggggagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggc

SEQ ID NO: 7243 - DNA, 2095 bp, Homo sapiens
ctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggaccctgatgaaaagactgaggaaaatgctgcctttcctgaatggctaccaggcagggaatgatgctgggaagtgtttaccccacaggctctgtgccttctctgactgggcagctcatgctgtatgcatggaggcatcattaccaaacacacctctgaggccagcggccagcgtctgactcacaagccatgactgccccaccttcttacaacaacaatagcagtttccccgtgaggattcacccctcctcccctctcactccgcctttttccagggaagctgactctaccctttggaccacagcttggagcacttgaccctggctaagctggtcagggcagcgggtctccctcccctgaagcctcatgattggcatgaggacaacacgtgacctatgtgtggctgcccaggacccacataggcttaacggtgggattttgtttgactgtgtgataagtgggttcttccttccctgctgagtgtgaagataaaaaagacttgaggtctggggcccacttggagcctgtttgagaatgaagccaagttatgggaagcaacaaaactgaagagacagcaaggaaaccaggcctggtggtgcactcccagctattctggaggctgacgcgggaggactgcgtgagctcagcagtttgaggctgcaatgagccatgatttcactactgaactccagcctgggcaaaagagcgagaccctgtgtctcagaaaaagagagagagaaacagagagcaaggagcaggtgggttataatggagtccctgcaccaagcagagcctgatgcccgcccttgctctgaacttcctagttatgtgaaccaaccaccaggccagttgggttgggtttccagccctgtgctcttgtctgtcctcactgacagacaaaaataactcatcagtcggttctcagacccacagtcccatgacatttcttgactgtttcagaagtaatgcctcaaggaccagcttgcagaaagtggaggacctgccccctggaccttacaagtagcaggccactcttaaaaatgcaaggaccacagatgtcaccatgactgaaaaatagaggctggccctgcctctgaagatgctgcaatggacttgtgttcaaggagaaattggctgtaacttcccttattgagatataatcgggctcatcgttaagctgtggtcagccagaagtgtagctgtgcccctgggattgaaatcagcaatcaatctggacatcctttttctatcttcatgaggcacctccccagtaccaaccaaatttcttggggatcccccgggacttctcataaatggaattgatttgaactcaggaaaccctcaaataggccagaacaactcactaattaaattcatcccctcccaaaaacaaaaacaaaaacaaaaaaaaacaacacacatgataggaaaaaaattttgcaaattatatatctgatatagaacttgtattcagaacatataatgaactcttacaactcaataagactggtaacccaattaaaaattctttttaaaaaaaccaatttaaaaataaaggcaaataacctaa

SEQ ID NO: 7244 - DNA, 756 bp, Homo sapiens
gggcttcctgcctcagccttctgctgctttgctctctgggagatccagctccttgctctgtgtcccagtagaacatgatgtggcccatgcacaccccactgctgctgctgactgccttgatggtggccgtggccgggagtgcctcggcccaatctaggaccttggcaggtggcatccatgccacagacctcaatgacaagagtgtgcagtgtgccctggactttgccatcagcgagtacaacaaggtcattaataaggatgagtactacagccgccctctgcaggtgatggctgcctaccagcagatcgtgggtggggtgaactactacttcaatgtgaagttcggtcgaaccacatgcaccaagtcccagcccaacttggacaactgtcccttcaatgaccagccaaaactgaaagaggaagagttctgctctttccagatcaatgaagttccctgggaggataaaatttccattctgaactacaagtgccggaaagtctaggggtctgtgcaaggcctgtcacactgaccacctcctactcccaccccctgtagtgctcccacccctggactggtggcccccaccctgggggaggtctcctcatgcgcctgcaccaggagacagacacagaaggtggcaggaggcctttgttgctcagcaggaggctctgcccttgctccttccttcttgcttctcatagccccagtgtgcagtgcacactctcccacctcctgcaattaaacagtagcattgc

SEQ ID NO: 7245 - DNA, 751 bp, Homo sapiens
gggctccctgcctcgggctctcaccctcctctcctgcagctccagctttgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggaggacagaatgtccctggtgaattccaggtgtcaagaagcctaggggtctgtgccaggccagtcacaccgaccaccacccactcccacccactgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 7246 - DNA, 748 bp, Homo sapiens
gggatccccgcctcaggctctcaacctcctctcctgcagctccagctctgtgctctgcctccgaggagaccatggcctggcccctgtgcaccctgctgctcctgctggccacccaggctgtggccctggcctggagcccccaggaggaggacaggataatcgagggtggcatctatgatgcagacctcaatgatgagcgggtacagcgtgcccttcactttgtcatcagcgagtataacaaggccactgaagatgagtactacagacgcctgctgcgggtgctacgagccagggagcagatcgtgggcggggtgaattacttcttcgacatagaggtgggccgaaccatatgtaccaagtcccagcccaacttggacacctgtgccttccatgaacagccagaactgcagaagaaacagttgtgctctttccagatctacgaagttccctgggaggacagaatgtccctggtgaattccaggtgtcaagaagcctagggatctgtgccagggagtcacactgaccacctcctactcccaccccttgtagtgctcccacccctggactggtggcccccaccctgtgggaggtctccccatgcacctgcagcaggagaagacagagaaggctgcaggaggcctttgttgctcagcaggggactctgccctccctccttccttttgcttctcatagccctggtacatggtacacacacccccacctcctgcaattaaacagtagcatcacc

SEQ ID NO: 7247 - DNA, 760 bp, Homo sapiens
gggctccctgcctcgggctctcaccctcctctcctgcagctccagctttgtgctctgcctctgaggagaccatggcccagtatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacacccccccacctcctgcaattaaacagtagcatcgcctccctctga

SEQ ID NO: 7248 - DNA, 655 bp, Homo sapiens
caggaagtcacatagctttcacagtcaaaggaccagtgtcacctctgtggagacctgggtgactcaagcttgggagcactggggaagagaggcatggctcggggaggctgcactccagctttgtgctctgcctctgaggagaccatggcccagtatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccc

SEQ ID NO: 7249 - DNA, 1952 bp, Homo sapiens
ggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagacc

SEQ ID NO: 7250 - DNA, 2129 bp, Homo sapiens
ggcttgttcctgtttgcatgacaggaaactcctgaaatgcccctcgcacgtgcaagacgttttccgcggtggcggcgacagggcgcacagtgggaccgcagcacgagctcggagcacccccagagtcggcgactcctgcccccgcccctgccggccggccttcccggggcctaggagggcagcaccgccgggcttcgcgccatgacatcagccctggagtggtgcagtgtgcaaagcccactggttggcgtggcccgggacacgccttccgcggagcggaacaaaacggcgcgcaggccgggcgcacccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccagaa

SEQ ID NO: 7251 - DNA, 1469 bp, Homo sapiens
atcctttagagtgcctagcacagggctgaaaatgcagcagctgctctgtaaagacctgttgattagattggggggaggaaatccccgagaacgtgcgaggctgctgtcgagagctagcagaaagtgctctgccaggcctggtggccccccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctg

SEQ ID NO: 7252 - DNA, 1149 bp, Homo sapiens
gtgcgtgacccagggcgacccggctccccgcaaccgcctgcaagtcgggcagaacaatcggcgattctgcgcgccactgacgctcattgtatggcagagagatgagggcatccgtgccaccccctccctcaccctcctgctggggagaaaatgcccgcgggcggggtggggcaaacatctgggcctgaccttggacatctgtgtccctgagcgcagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccctcagcactgacaagggggagtcgctgggtatcaagcacgaggaagcccctggccacaggcccaccaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacat

SEQ ID NO: 7253 - DNA, 1749 bp, Homo sapiens
agccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggcagggcgcaggcaccaaccccaatgcatccaaatttgcccagaagattggtggctccgagcgctgcccccgatgcagccaggcagtctatgctgcggagaaggtgattggtgctgggaagtcctggcataaggcctgctttcgatgtgccaagtgtggcaaaggccttgagtcaaccaccctggcagacaaggatggcgagatttactgcaaaggatgttatgctaaaaacttcgggcccaagggctttggttttgggcaaggagctggggccttggtccactctgagtgaggccaccatcacccaccacaccctgcccactcctgcgcttttcatcgccattccattcccagcagctttggagacctccaggattatttctctgtcagccctgccacatatcactaatgacttgaacttgggcatctggctccctttggtttgggggtctgcctgaggtcccaccccactaaagggctccccaggcctgggatctgacaccatcaccagtaggagacctcagtgttttgggtctaggtgagagcaggcccctctccccacacctcgccccacagagctctgttcttagcctcctgtgctgcgtgtccatcatcagctgaccaagacacctgaggacacatcttggcacccagaggagcagcagcaacaggctggagggagagggaagcaagaccaagatgaggaggggggaaggctgggttttttggatctcagagattctcctctgtgggaaagaggttgagcttcctggtgtccctcagagtaagcctgaggagtcccagcttagggagtcactattggaggcagagaggcatgcaggcagggtcctaggagcccctgcttctccaggcctcttgcctttgagtctttgtggaatggatagcctcccactaggactgggaggagaataacccaggtcttaaggaccccaaagtcaggatgttgtttgatcttctcaaacatctagttccctgcttgatgggaggatcctaatgaaatacctgaaacatatattggcatttatcaatggctcaaatcttcatttatctctggccttaaccctggctcctgaggctgcggccagcagagcccaggccagggctctgttcttgccacacctgcttgatcctcagatgtggagggaggtaggcactgcctcagtcttcatccaaacacctttccctttgccctgagacctcagaatcttccctttaacccaagaccctgcctcttccactccacccttctccagggacccttagatcacatcactccacccctgccaggccccaggttaggaatagtggtgggaggaaggggaaagggctgggcctcaccgctcccagcaactgaaaggacaacactatctggagccacccactgaaagggctgcaggcatgggctgtacccaagctgatttctcatctggtcaataaagctgtttagaccag

SEQ ID NO: 7254 - DNA, 943 bp, Homo sapiens
caccgagcgctctttaaaaggcaccggcgcgcgcttcgcctgggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttga

SEQ ID NO: 7255 - DNA, 754 bp, Homo sapiens
gcctgggatctcggactccctggaccctccctccagcccagcctcgctagctccgcctgcgaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgta

SEQ ID NO: 7256 - DNA, 1341 bp, Homo sapiens
caggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgtattataaatg

SEQ ID NO: 7257 - DNA, 1456 bp, Homo sapiens
gcagtgagccgagatcgcgccactacactccagactgggcgacagagccagactccgtctcaaaaaaaaaaaaaaaaaaagagagagagcaccttaggaatcatctgcctcacacgaatattctcaggccaaggctggtgacagccttcatatatttaaagaggacaagagcccctcagactcagttgagctgaacggagtccacacaggcagacttgaccttgaccagatagtcttcaagatgccaaactggggcggaggcgcaaaatgtggagcctgtgaaaagaccgtctaccatgcagaagaaatccagtgcaatggaaggagtttccacaagacgtgtttccactgcatggcctgcaggaaggctcttgacagcacgacagtcgcggctcatgagtcggagatctactgcaaggtgtgctatgggcgcagatatggccccaaagggatcgggtatggacaaggcgctggctgtctcagcacagacacgggcgagcatctcggcctgcagttccaacagtccccaaagccggcacgctcagttaccaccagcaacccttccaaattcactgcgaagtttggagagtccgagaagtgccctcgatgtggcaagtcagtctatgctgctgagaaggttatgggaggtggcaagccttggcacaagacctgtttccgctgtgccatctgtgggaagagtctggagtccacaaatgtcactgacaaagatggggaactttattgcaaagtttgctatgccaaaaattttggccccacgggtattgggtttggaggccttacacaacaagtggaaaagaaagaatgaagaggtgcgccgtttctcagattttttgcgagcctaaaacacttgccaagtaatcctgcacagatcgatacctttccccaaatagcctctcctttgtagtcgtacattatgtgtttctcctcagaagtgatcaggtctttactgaatgttagaagaggcctttggaagaaaattatgtaaagtttaatctataacaaatgctttattatttataatgcttggaatgggagaggcaataaataaatgttttagtgctatcttgtatggctctagatcttttctttgagatagaaattttcaaaaacataaagctagttcaaaaaacgagttgcagagcatataataaatttggatgtcaactgagaaaggagtgagaaggaagaaacaatgcgcaaaggaaagcagtctttcagaatctgtcagccaagtgtctttctagttactgctaatggagaagaaaacagggggtctgggagaaaatagagaacatgatagcaaaatctaaaaggaaaatcaaaactaataaaattgctgaagagttgatccctttgtcctatcgtggggctttgtaatgttacacatctcgtgaaaactcagaaatgacaataaagcgtggcatttgcctctgta

SEQ ID NO: 7258 - DNA, 2070 bp, Homo sapiens
cgcgatcgcggcggaccccaccgtcatcgcgcgccgtgagtcacactccacagccaatccctggccacatccgggctcgcccccgccccgcccccttgttcccgcaagcccggaactgcccaaatcccgcccctcccctcccaaaaaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgca

SEQ ID NO: 7259 - DNA, 1867 bp, Homo sapiens
gaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaatataatgcatgtacagtaaagttcacaaatcttaaatgtacagctggataaattactgtgtaaatttctgtgcaactacaaccagacaaagatatgatacatttccagtacccagaaaacttctttgttcctcttcagagtctatattctcccagaggtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttc

SEQ ID NO: 7260 - DNA, 1019 bp, Homo sapiens
ccaccccttccctcctccatttccatccattccgcgatcgcggcggaccccaccgtcatcgcgcgcccctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagcatgtttttggcccagaggagcctctgctctcttagcggtagagcaaaattcctgaagacaatttcttcttccaaaatcctcggattctctacttctgctaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatag

SEQ ID NO: 7261 - DNA, 1868 bp, Homo sapiens
aaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgactttagccggt

SEQ ID NO: 7262 - DNA, 1903 bp, Homo sapiens
ttctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatcctta

SEQ ID NO: 7263 - DNA, 1623 bp, Homo sapiens
ttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaaga

SEQ ID NO: 7264 - DNA, 2105 bp, Homo sapiens
gtcgccatctttatgaggagaattctagcggcgctttctcccgctctcgcctccgcgctagcgccctgctgcttcggggcggaagtagcggagccgggctcggcccccttaaagggacagggactgctgcaacctacggggtgtacttgggaacgaggggtgaagcggcccaggtgaggctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtctcactctgttatccaggctggagtgcaatggtgcgatcatggtccactgcagccttgaccctgccagtctcaagtggtcctcccacctcagcctctggagtaactgggactacaggctggtctcagagctggttggaaagttccttctttgatccaaaaaaaaaaaaaatcatttggggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatcctta

SEQ ID NO: 7265 - DNA, 736 bp, Homo sapiens
ggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaac

SEQ ID NO: 7266 - DNA, 477 bp, Homo sapiens
gccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtctcactctgttatccaggctggagtgcaatggtgcgatcatggtccactgcagccttgaccctgccagtctcaagtggtcctcccacctcagcctctggagtaactgggactacaggctggtctcagagctggttggaaagttccttctttgatccaaaaaaaaaaaaaatcatttggggttacccaccactgacgaagatcctggcaagtttctttggggagctgctgggtcaggagatagacccgctcaggaatgtgctggtgactgtt

SEQ ID NO: 7267 - DNA, 1989 bp, Homo sapiens
acttgggaacgaggggtgaagcggcccaggtgaggagctgtgtgtgggggacccaagtcctgagctcggaggcattttctggccagggctgtttcctcccttctcccctgcctctggaaaagtctgcagtgccccaaggctctgggaggcatgttcaggactgcagcagccatctctgtgcacctggtggggccccttcagggaaggaaggctggagccccactcacttggttcttgcaccagactcaggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgccactggctggaaggtgggctgggtcctgggtccagatcacatcatgaagcacctgcggaccgtgcaccagaactccgtcttccactgccccacgcagagccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcaagaggaagatgcctgacttgcctggagctgtggatgagccctatgacagacgcttcgtcaagtggatgatcaagaacaagggcttggtggccatccctgtctccatcttctatagtgtgccacatcagaagcactttgaccactatatccgcttctgttttgtgaaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctg

SEQ ID NO: 7268 - DNA, 847 bp, Homo sapiens
cacaggggtgcctgggagggggctcgcgcgccgcggagccggcgagaaggtggtgccccggagactccgggcactggggagcccagagctcgccatggccaaacagctgcaggcccgaaggctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtcatcatcatcgaacccttttttgactgctacgagcccatgacaatgatggcagggggtcgtcctgtgtttgtgtccctgaagccgggtcccatccagaatggagaactgggttccagcagcaactggcagctggaccccatggagctggccggcaaattcacatcacgcaccaaagccctggtcctcaacacccccaacaaccccctgggcaaggtgttctccagggaagagctggagctggtggccagcctttgccagcagcatgacgtggtgtgtatcactgatgaagtctaccagtggatggtctacgacgggcaccagcacatcagcattgccagcctccctggcatgtgggaacggaccctgaccatcggcagcgccggcaagaccttcagcgcc

SEQ ID NO: 7269 - DNA, 1860 bp, Homo sapiens
agcggcggaggtggagcggggagaggcgttaggccgggcggctaaaacgcgccgttaaagtgggggagagattgcgcggagcccacgcgatccctgggacgccggagacaacggggctcttgggaaggcgcggagcccggggaagccggggatgtgcgcgtgagccgtgcccgcagggtctccccgcctccgccacctttcttgggtggctctccgcctcgtcctccctccgagggccgttggtacattcctagtgactccaagcgcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtatacccgaaatcttgtggatcaaggaaatggaaaatttaatctgatgattctctgttggggtgaaggacatggcagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatgattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaa

SEQ ID NO: 7270 - DNA, 5912 bp, Homo sapiens
gccgccggcccgggctggagccgagcgcagcagccaccgccgccgccgcgccagaagtttgggttgaaccggagctgccgggaggaaacttttttcttttttccccctccctcccgggaggaggaggaggaggaggaggggaagctgccgccggcgccaaggctcgtgggctcggggtcggcgcggcccgcagaaggggcgggggcctcgccccgcgaggggaggcgcgccccgggggccccgagaggggcggtgaggaccgcgggctgctggtgcggcggcggcggcgcgtgtgccccgcgcaggggagggcgcccgccccgctcccggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcaccgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatca

SEQ ID NO: 7271 - DNA, 1194 bp, Homo sapiens
acgcgcccgcccgcccgttggcccgggaagtctcgcgatgccgtagccggctgctcccgctgcgggtggctcgggctgttgctgtggtttcctgagttgctgctgctgcggcggcggcagcggcgtctgtgcttgtggaggtgtcggcctctgggcggatgttgacattgtgttgttgttattgctgatggtaatggcggcggcggtggcggcgacggtccagaccccatcccctctgtagccggagccgagacagccgacagcgaactccgcggcctcggagccggcggcagcggcgactcccctcagcctccgccgcctcgcccgccggtaccccggcgccaaccccgggagtcaggccctttgggcaggggagctcggaggctcaggatggcggatttcgacgaaatctatgaggaagaggaggacgaggagcgggccctggaggagcagctgctcaagtactcgccggacccggtggtcgtccgcggctccggtcacgtcaccgtatttggactgagcaacaaatttgaatctgaattcccttcttcattaactggaaaagtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagaacacgaagatcgattgagaagttattagaatgggaaaacaataggttataccacaagctgtgcttgcattggagactgagcaaaaggaaatgtgaaacgaataacatgatggaatatgtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgtttttgttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaa

SEQ ID NO: 7272 - DNA, 1311 bp, Homo sapiens
aactttgcagcgtacttggaccgctctggccgccctgggcgctacccgcagagataagggcccctccctgcgcccggtccgggcatctccgagccggcctgggggtggctgaactctcttttgccggccgaaaccccagcccccgcagcccccgcagccgatcggtcctcaagctacagctcccctctctgggagtccccgcttttgaattccccggggatgttcccgctgcggtccgatggacctcccagagcagcggaggtcaggggagctagcagaggcggggacgtcccttgggagtgaggggactgacaggggcggcctcgtaaccctgcgtgggatggaaggtcagagtgggttcctcggtggggggcaacagcgggggctctccggcaattgtccccgaccctccgtcctggggagggcaggatcagcgcgcgggctgctttgcatctctttgcattttagtgatgtttggtccagtcctggcccgggcagatctggggttcgggcgggtgccggtggggtagggctgggggtgggagcggcgtttcctgctgcgggtgagccttttgcctcggaactggacccgggagacatcacagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacc

SEQ ID NO: 7273 - DNA, 485 bp, Homo sapiens
cacagcgctgggctaggggcgcggcttgaactcgcctaaagagctgcgccctctcatctcgcgcctgcagcccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacc

SEQ ID NO: 7274 - DNA, 677 bp, Homo sapiens
tttcctgctgcgggtgagccttttgcctcggaactggacccgggagacatcacagcgctgggctaggggcgcggcttgaactcgcctaaagagctgcgccctctcacccgtgccgccccagccgctgccgcctgcaccggacccggagccgtcatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcagg

SEQ ID NO: 7275 - DNA, 1849 bp, Homo sapiens
gcgccttccttcctgagccctgccctccacccaaggagccttcagcaccacagacagtgttggggcggggcgcgggcgggggcggagcgggacatggagacccggacagggctgggggccgtgcccgccgggaatctgactccgctcccgcggcgcggctgttgctatggaaaccgagcaacaaagggaagcgggacaggcgccgcgcgcggcggggtgggggtggggttctcccggagcctgcgaccccttcccgcggcggagcgcagcctgggcgcccagggccgggagtgttggacccctaggcccaagtcactagggctccccgagagccgagggccaggctccccgcaccctgcccgccgccccggggacggcccggccaggcggccccgacgtcgccatggaaacagccggggcgcgggcggcgccgcggtcgcccgggcgggcccctgtagacgccacctccggcgcgaggggcccgggggcgccaggcctggcccggctgccccgcacccgccacccccggcaggtgcgccccgcccccgcggcgcccccaggcggcccccagcccgggggacgggttatcgaggccccgccccggccgcggagccaatgggcgcgcggacagccgggcaggcggggctgggcgcgggcggcggcggcccggaggagaacgggcggagggcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgca

SEQ ID NO: 7276 - DNA, 1176 bp, Homo sapiens
ggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccag

SEQ ID NO: 7277 - DNA, 817 bp, Homo sapiens
gcccggaggagaacgggcggagggcgcgggccgaccgggcgcaccgaccatggcctccaaatgccccaagtgcgacaagaccgtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgagga

SEQ ID NO: 7278 - DNA, 1709 bp, Homo sapiens
gggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttg

SEQ ID NO: 7279 - DNA, 1911 bp, Homo sapiens
aaatctcccctgtggactgtcatttaaaagcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttgaaaaaaaaaaaaaa

SEQ ID NO: 7280 - DNA, 1798 bp, Homo sapiens
gggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttg

SEQ ID NO: 7281 - DNA, 1296 bp, Homo sapiens
agtttctttgcagctaccaggacagagcttggtgagataattcttttattcttcaacttttattttaacttcaatggtacatgtgcagggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgagggaaatgatcctgaaacaaagaatgaaccttataagacaggcgtcccatgtgaagcctgcccaagtaactgtgaagacaaactttgcactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaa

SEQ ID NO: 7282 - DNA, 1793 bp, Homo sapiens
gcacaaatacactacatagagaaaggcttggttcttatcaggacacaaatttaaaggctgtgtggacttggggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagcaaacagagttcagtctcatcttgcaaggtaaatatcatttaattggaagtagtttaaatgtctcattgttttattgacacatctatatatacatttgtgaagcaagaaacaataaaaaagcttcgtatgccattaatttaacaaaatatgtattcagtactgattgcatacaagatgcatgtttatatatatggaaggaatatagtttcatttcattgcaaaggcagtataaaagatatataaaatagcataatatgagaaattaagtccctaaagacatataggtcacatattattattgccagatgagcataaatagcttctgtttggagattcaggaaagccttagggtggaatgaggaacatcttctgagtaaacagggttgcaaaggttatgattatttcaacacaatggaagagcacagttaaggccaactaacgtaaaatgcactgaagccttagggaatattgaagggcctgacatggggaaagggaaggctaaaaatacttggtcaaattttaacattataccaaagttatacccagttctacctacttgtatatttctttactcatttcaataaagtgtttgaaaaaaaaaaaaaa

SEQ ID NO: 7283 - DNA, 1204 bp, Homo sapiens
agtttctttgcagctaccaggacagagcttggtgagataattcttttattcttcaacttttattttaacttcaatggtacatgtgcagggatggaaattaaacacctcttgtttttggttgctgctgcttgcttactgcctatgttgtccatgaaaaagaaatcagctagagaccaatttaataagctcgtcaccgacttgccaaatgtacaagaagagatcgttaatatacacaacgccctcaggagaagagtagttccaccagccagcaacatgctgaagatgagttggagtgaagaggctgcacaaaatgccagaattttttcaaagtattgtgatatgacagagagcaacccccttgagaggagacttccaaataccttttgtggagaaaatatgcatatgacatcttatcctgtatcatggtcaagtgtaattggagtctggtacagtgagtctacaagtttcaaacatggagaatggacaacaacggatgatgacataactactgaccactacactcagattgtttgggccacatcttacctgattggctgtgccattgcatcttgccgccaacaaggatcacctcgatatctctacgtttgtcactattgtcatgactaacccctgcatctactatgatgaatacttcgactgtgacatacaagtccattatctgggatgcaaccactcaacaactatcctattctgtaaagccacttgtctgtgtgacactgagataaaataggtctttgttattttcaactgttctatgctgtgacgatgaggaggagatgtctgttggattcatgtcttttgctatagttcagtagcttctgctaaatttcactgattttaatcatgctggagaccttaactcccatcctgatacatcctgaagtaacactgttttaaactttcttagtgctggagtaaaaggtcaagtccaacacctgccttaaatttaaatcatgtgatttatagtttttaagttggcataattcaacttatggtataactgggtccctcaacagtaacctgggctaaaataggtcttatgtggttcaactcccacccccgccttccccatattttcaaccactctgattatcttccctgcacaactaacatccagtaataattcttcacttttaaaattttacttctactttaaatcaatcattaaaggaatccacaaagc

SEQ ID NO: 7284 - DNA, 1439 bp, Homo sapiens
gtggcgcctggcaagtgaacaatcgcggtgagaggggcgcgccgcagctcctcaacgccgcaacgcgccggcccaactgcaggaagggttataaaattatacaccatggccctcctaaagacactctaggaaaaccatgtcatcctgatcttaaaacacctgcaagaaagagcacagtacttcaccattagtttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgcaatgaaaacatatctcaataaaagggaggggataaacgtttggaaatgttttttaaggttgagacactttcaacttctcagaggagaacaacttctcactttcagtggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaag

SEQ ID NO: 7285 - DNA, 1382 bp, Homo sapiens
cggtgagaggggcgcgccgcagctcctcaacgccgcaacgcgccggcccaactgcaggaaggtctgtgctctggagccagggtaaatggttataaaattatacaccatggccctcctaaagacactctaggaaaaccatgtcatcctgatcttaaaacacctgcaagaaagagcacagtacttcaccattaataaagtagatatttcatcctgctcagaaaaccaacatttccagcaatggctttactaccggtgttgtttctggttactgtgctgcttccatctttacctgcagaaggaaaggatcccgcttttactgctttgttaaccacccagttgcaagtgcaaagggagattgtaaataaacacaatgaactaaggaaagcagtctctccacctgccagtaacatgctaaagatggaatggagcagagaggtaacaacgaatgcccaaaggtgggcaaacaagtgcactttacaacatagtgatccagaggaccgcaaaaccagtacaagatgtggtgagaatctctatatgtcaagtgaccctacttcctggtcttctgcaatccaaagctggtatgacgagatcctagattttgtctatggtgtaggaccaaagagtcccaatgcagttgttggacattatactcagcttgtttggtactcgacttaccaggtaggctgtggaattgcctactgtcccaatcaagatagtctaaaatactactatgtttgccaatattgtcctgctggtaataatatgaatagaaagaataccccgtaccaacaaggaacaccttgtgccggttgccctgatgactgtgacaaaggactatgcaccaatagttgccagtatcaagatctcctaagtaactgtgattccttgaagaatacagctggctgtgaacatgagttactcaaggaaaagtgcaaggctacttgcctatgtgagaacaaaatttactgatttacctagtgagcattgtgcaagactgcatggataagggctgcatcatttaattgcgacataccagtggaaattgtatgtatgttagtgacaaatttgatttcaaagagcaatgcatcttctcccccagatcatcacagaaatcactttcaggcaatgatttacaaaagtagcatagtagatgatgacaactgtgaactctgacataaatttagtgctttataacgaactgaatcaggttgaggattttgaaaactgtataaccataggatttaggtcactaggactttggatcaaaatggtgcattacgtatttcctgaaacatgctaaagaagaagactgtaacatcattgccattcctactacctgagtttttacttgcataaacaataaattcaaagctttacatctg

SEQ ID NO: 7286 - DNA, 4637 bp, Homo sapiens
ggcctccgggctccggggagcctacaagaggcggtacgctgagccccggcacccactcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcccatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaacgggaaggtccccttcttcgtgaagtctgagagacacggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcaccgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggctgtctttttttttttttttttttttttcccgagaccaagtttcactctgttgcccaaggtagagtgcagtggcgtgatctctgctcattgcaactgccgcctcccgggttcaagcaattctcatgcatcagcctcccaagtacctgggactacaggcgtgagctaccatgcccggctaatttttgtatttttagtagagatggggtttcattatgttggccaggctggtctcgaactccttacctcaggtgatccacccaccttggcctcccgaagtgctgggattacaggcatgagccactgcgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaacca

SEQ ID NO: 7287 - DNA, 1994 bp, Homo sapiens
aggagacggcccacggcgcccgcgggctggggcggtcgcttcttccttctccgtggcctacgagggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccaggtgcattccccatcttaactgatttaacccctgaaacaacccgacgctggaagttgggttctcatccccactctacatatgtaaaaatgaagatgcagagagatgaagctactttcccagggctatatggcaagcaagtcgcaaagctgggatcccaatccagacagtctgaccgtggaacgagactcatacacagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaa

SEQ ID NO: 7288 - DNA, 2696 bp, Homo sapiens
tggcagcgacgcggtgaggagacggcccacggcgcccgcgggctggggcggtcgcttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacaacccctctggcctcctctccttcagtacttggaatctgatctcttctccctaattctgcggatccggcccctaatattctttatcagaccctcagacaagaggctgacttctgcccccttgtcaaggagcgaggccactttcctctccaccccatgctagcgaggataacttatttctcttctggaattgcatcttatgcgcctttccccacccatccccacagcccctgcaatacccagtttggcctcttttgcttgtaataacgcagatcccagcgccacggcaccttagaacagacctttttctttctcgcgtggggcctgactccttcagtgaagcctctccacgccctctatctgcaggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatctcaggaaataaagaaaggtcttggaaagttaaaaggcatcagtcttactacctgtcccaccacccccaccttagggaaatgtcctagaatcctgggaaattgagggcttctttgatggtgagtggagaaaagatagaggagaaggttgcccctgaagtgctgttaggagaaggaggatagaggaatcagccttaggagggttccatgccagctgtcatttggcaaaggaccctggacagatgacttttgcctctgaacttcactcttctctttcctcaaatgggcttcataatgctttccactcaggcttaacatgagaattaaatgaggtgacaaatgtgaagacctggacagtacacaacagatattcaataaaagtgtggtcgccattatgaccagagcctccaagcctcaa

SEQ ID NO: 7289 - DNA, 1728 bp, Homo sapiens
tgcgttttacgcaggctgtggcagcgacgcggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttatt

SEQ ID NO: 7290 - DNA, 1778 bp, Homo sapiens
gcgacgcggtgaggagacggcccacggcgcccgcgggctggggcggtcgcttcttccttctccgtggcctacgagggtccccagcctgggtaaagatggccccatggcccccgaagggcctagtcccagctatgctctggggcctcagcctcttcctcaacctcccaggacctatctggctccagccctctccacctccccagtcttctcccccgcctcagccccatccgtgtcatacctgccggggactggttgacagctttaacaagggcctggagagaaccatccgggacaactttggaggtggaaacactgcctgggaggaagagaatttgtccaaatacaaagacagtgagacccgcctggtagaggtgctggagggtgtgtgcagcaagtcagacttcgagtgccaccgcctgctggagctgagtgaggagctggtggagagctggtggtttcacaagcagcaggaggccccggacctcttccagtggctgtgctcagattccctgaagctctgctgccccgcaggcaccttcgggccctcctgccttccctgtcctgggggaacagagaggccctgcggtggctacgggcagtgtgaaggagaagggacacgagggggcagcgggcactgtgactgccaagccggctacgggggtgaggcctgtggccagtgtggccttggctactttgaggcagaacgcaacgccagccatctggtatgttcggcttgttttggcccctgtgcccgatgctcaggacctgaggaatcaaactgtttgcaatgcaagaagggctgggccctgcatcacctcaagtgtgtagacattgatgagtgtggcacagagggagccaactgtggagctgaccaattctgcgtgaacactgagggctcctatgagtgccgagactgtgccaaggcctgcctaggctgcatgggggcagggccaggtcgctgtaagaagtgtagccctggctatcagcaggtgggctccaagtgtctcgatgtggatgagtgtgagacagaggtgtgtccgggagagaacaagcagtgtgaaaacaccgagggcggttatcgctgcatctgtgccgagggctacaagcagatggaaggcatctgtgtgaaggagcagatcccagagtcagcaggcttcttctcagagatgacagaagacgagttggtggtgctgcagcagatgttctttggcatcatcatctgtgcactggccacgctggctgctaagggcgacttggtgttcaccgccatcttcattggggctgtggcggccatgactggctactggttgtcagagcgcagtgaccgtgtgctggagggcttcatcaagggcagataatcgcggccaccacctgtaggacctcctcccacccacgctgcccccagagcttgggctgccctcctgctggacactcaggacagcttggtttatttttgagagtggggtaagcacccctacctgccttacagagcagcccaggtacccaggcccgggcagacaaggcccctggggtaaaaagtagccctgaaggtggataccatgagctcttcacctggcggggactggcaggcttcacaatgtgtgaatttcaaaagtttttccttaatggtggctgctagagctttggcccctgcttaggattaggtggtcctcacaggggtggggccatcacagctccctcctgccagctgcatgctgccagttcctgttctgtgttcaccacatccccacaccccattgccacttatttattcatct

SEQ ID NO: 7291 - DNA, 2016 bp, Homo sapiens
gcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggtgtgaagatgcggttccgctgcgaagatggggagacattttccaagaacgtcatgatgatccagtcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 7292 - DNA, 2290 bp, Homo sapiens
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaataaagattctgaagctaaatttgtgatttaa

SEQ ID NO: 7293 - DNA, 1336 bp, Homo sapiens
agaccgcgagcgagagcgcccccgagcagcgcccgcgccctccgcgccttctccgccgggacctcgagcgaaagacgcccgcccgccgcccagccctcgcctccctgcccaccgggcccaccgcgccgccaccccgaccccgctgcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaa

SEQ ID NO: 7294 - DNA, 2576 bp, Homo sapiens
gagcaggcactctgtgaatggactgtgcttttacgaccctacagggtatcaagatactgtgcagctcgccaacaaggattaattgcaaggactggtagatcgaatttactgaagacttggagcttgcttctgagaacaaacgcaaaaggacagtaaactgtggaccttgaagttagcagcgtgggcttcctctaatattacaccgtaaaaggcattgatcaccataagaaggaacatttgtgaaggtactccagtgccagaaagaggcacaaagcagacattcgtagagaaacatggatgaaacaggaaatctgacagtatcttctgccacatgccatgacactattgatgacttccgcaatcaagtgtattccaccttgtactctatgatctctgttgtaggcttctttggcaatggctttgtgctctatgtcctcataaaaacctatcacaagaagtcagccttccaagtatacatgattaatttagcagtagcagatctactttgtgtgtgcacactgcctctccgtgtggtctattatgttcacaaaggcatttggctctttggtgacttcttgtgccgcctcagcacctatgctttgtatgtcaacctctattgtagcatcttctttatgacagccatgagctttttccggtgcattgcaattgtttttccagtccagaacattaatttggttacacagaaaaaagccaggtttgtgtgtgtaggtatttggatttttgtgattttgaccagttctccatttctaatggccaaaccacaaaaagatgagaaaaataataccaagtgctttgagcccccacaagacaatcaaactaaaaatcatgttttggtcttgcattatgtgtcattgtttgttggctttatcatcccttttgttattataattgtctgttacacaatgatcattttgaccttactaaaaaaatcaatgaaaaaaaatctgtcaagtcataaaaaggctataggaatgatcatggtcgtgaccgctgcctttttagtcagtttcatgccatatcatattcaacgtaccattcaccttcattttttacacaatgaaactaaaccctgtgattctgtccttagaatgcagaagtccgtggtcataaccttgtctctggctgcatccaattgttgctttgaccctctcctatatttcttttctgggggtaactttaggaaaaggctgtctacattcagaaagcattctttgtccagcgtgacttatgtacccagaaagaaggcctctttgccagaaaaaggagaagaaatatgtaaagtatagtttaaacccatttccagtccaaaccaatgaaaatagtttcccaaataagtattttgtcaaatcatttacaaaaaaaataaaaattttacttaatattttacaaatacttaactatttgggcctacaactctatctcatttatgcatccacatgattagatatttatagatattttaagtgctaaaaattcggtccacaactatgaactgaattataaataattttgaccactcaccagaatttggagaatatttttatctttgcactataaaatatgtcttatattaaagttttcctcttcaaataaaagctttacaaacgataaaatatataaaattagtcaataaaaatacatgcaagctaaaagttataaaatataaaactagatataaaattggcaaatagttctgaatcattctaacatattcctttgcatgcatgccatcagatgagaactggagatgactcaggagctacataaaacgtactgtcacccttctttgtagtactgattcgctaggcaaattagggccatttcttccaaaagagaatgtaaaagtgctagaacagactagtattcagctaaagggtcctaaaagcaccatacaatgttcaatatggcaacaggagaaatctggtcaaaagccagtttgtctccagttttcttctgcctttgcctcaggctcccaaaattgaatagtggagttttagctgctcagtgaggttcctgtagagatttctctccatccatgacatataattcttccttaagaagccagacaactggcactcctatatataaatagaagtaattaaaaacttatctgaagaagagaaaaggaaaaggaatctacttttctatatgccaattgctgggatcaaaataaactacaaaggatttatgaagaaaattgtgaatgttcacattacaaattcttttaagaagtgcatacatttatgtatatgtatacaactatatgtaagagattttgctgtatgatatgcattatgggtgaaagttcacgataagttttattattgctttattactttttattggtatgttgacaggaatatcatggatatgtttacagtgacttttatattacagtggacgctttgatcttaaaacagccacaacaactcatctacggctgaaatataatatgcgtggacaagcttttgctgaagtgtagtgtgtcctttaagtttgttttttaaaaagtaacttacctcagaagaaataaataactataaagaaaaaagaaa

SEQ ID NO: 7295 - DNA, 2548 bp, Homo sapiens
agcatggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataaggagctcttagatgagacctgttcttgtatccttgtgtccatcttcattcactcatagtctccaaatgactttgtatttacatcactcccaacaaatgttgattcttaatatttagttgaccattacttttgttaataagacctacttcaaaaattttattcagtgtattttcagttgttgagtcttaatgagggatacaggaggaaaaatccctactagagtcctgtgggctgaaatatcagactgggaaaaaatgcaaagcacattggatcctacttttcttcagatattgaaccagatctctggcccatcaggctttctaaattcttcaaaagagccacaacttccccagcttctccagctcccctgtcctcttcaatcccttgagatatagccaactaacgacgctactggaagccccagagcagaaaagaagcacatcctaagattcagggaaagactaactgtgaaaaggaaggctgtcctataacaaagcagcatcaagtcccaagtaaggacagtgagagaaaagggggagaaggattggagcaaaagagaactggcaataagtaggggaaggaagaatttcattttgcattgggagagaggttctaacacactgaaggcaaccctatttctactgtttctctcttgccagggtattaggaaggacaggaaaagtaggaggaggatctggggcattgccctaggaaatgaaagaattgtgtatagaatggaagggggatcatcaaggacatgtatctcaaattttctttgagatgcaggttagttgaccttgctgcagttctccttcccattaattcattgggatggaagccaaaaataaaagaggtgcctctgaggattagggttgagcactcaagggaaagatggagtagagggcaaatagcaaaagttgttgcactcctgaaattctattaacatttccgcagaagatgagtagggagatgctgccttcccttttgagatagtgtagaaaaacactagatagtgtgagaggttcctttctgtccactgaaacaaggctaaggatactaccaactactatcaccatgaccattgtactgacaacaattgaatgcagtctccctgcagggcagattatgccaggcactttacatttgttgatcccatttgacattcacaccaaagctctgagttccattttacagctgaagaaattgaagcttagagaaattaagaagcttgtttaagtttacacagctagtaagagttttaaaaatctctgtgcagaagtgttggctgggtgctctccccaccactacccttgtaaacttccaggaagattggttgaaagtctgaataaaagctgtcctttcctaccaatttcctccccctcctcactctcacaagaaaaccaaaagtttctcttcagagttgttgactcatagtacagtaaagggtggaggtgatatggcattctgaaagtagggagggactaagtcagtcatcatactaaac

SEQ ID NO: 7296 - DNA, 2491 bp, Homo sapiens
agattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtga

SEQ ID NO: 7297 - DNA, 2758 bp, Homo sapiens
ccggggcggcggttgcatcagattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 7298 - DNA, 2685 bp, Homo sapiens
gactactcccagcacggccactgaacgcttggccgcgcgatgctccggagcgcgggtcgccattgggttgaactacagctcccagcatgctccgggccggcgacatccggagcccctggtagttgcctagcgaccgggcgtgtcccggaagacgggcccggcgtggggcgcgacttccggggcggcggttgcatcagattctaggaagtgtctgtagccgcagctgcgggtccgggattcccagccatggcagattcctccgggcagcagggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctc

SEQ ID NO: 7299 - DNA, 2778 bp, Homo sapiens
agattctaggaagtgtctgtagccgcagctgcgggtccgggattcccagccatggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtg

SEQ ID NO: 7300 - DNA, 2637 bp, Homo sapiens
ctgtagccgcagctgcgggtccgggattcccagccatggcagattcctccgggcagcaggcttttcctttgcggtcttgaaggtgcataggcttggtgcctgtccaagagcctgattatttcagaaggatgagtttcatttctgaggtttctggggtagatggagcctacctcagggcctttccgcacagacttgggataccacttggtcggctgctcatcaggcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaagtccctgagattctgcagctcagcgatgccctgcgggacaacatcctgcccgagcttggggtgcggtttgaagaccacgaaggactgcccacagtggtgaaactggtagacagaaacaccttattaaaagagagagaagaaaagagacgggttgaagaggagaagaggaagaagaaagaggaggcggcccggaggaaacaggaacaagaagcagcaaagctggccaagatgaagattccccccagtgagatgttcttgtcagaaaccgacaaatactccaagtttgatgaaaatgtaagcatggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtg

SEQ ID NO: 7301 - DNA, 1879 bp, Homo sapiens
agcgaccggcagcgtacccggcgtggctcccgtctccgcccagtcgtaggcgctggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaaggaacctgaagggccgagaagtcctgctgtgtttggtgccatcatctcttactttgaacagttttttgaaactgttggaatttctctggcaaatcaacagtacgtttcaggagacggcagcgaggctaccttgcatggtgtggtggacgagctggtgcggttccggcagaaggtccggcagtttgcgctggccatgcccgaggccacgggggacgcccggcggcagcagctcctagaaaggcagcccctgctggaagcatgcgacaccctgcgccggggcctgactgcccacggcatcaacatcaaggacagaagcagtacaacatccacgtgggaactgctggatcaaaggacaaaagaccaaaaatcagcgggctgaggatggagcacagccatgaacctgctcacgacaagacgcacccatgcttctcagggtcaaggctttatgttaaagcttcctgtcggggctgctaggtcagcattaaagtaaggcaaccaa

SEQ ID NO: 7302 - DNA, 1342 bp, Homo sapiens
ggccgctgacatgttgaggactacgcgcggcccaggcctgggccccccgctgctccaggccgcgctgggccttgggcgggctgggtggcactggcctgcgggccgggcggcgagcggggggcgcgggcgggcctggctgcagcccacgggccgggagacgggtgtgcaggtgtacaacagcctcaccgggaggaaggaacccctaatcgtggcgcacgccgaagccgcctcctggtatagctgtggaccaactgtatatgatcatgcgcaccttggccatgcttgctcatatgttagatttgatatcattcgaaggatcctaaccaaggtttttggatgcagcatagtcatggtgatgggtattacagatgtagatgataaaatcatcaaaagagccaatgagatgaatatttcccccgcttccctcgccagtctttatgaggaagacttcaagcaggacatggcagccctgaaggttctcccacccacggtgtacctgagggtaaccgaaaatattcctcagataatttctttcattgaaggaatcattgctcgtgggaacgcttattcaacggcaaaaggcaatgtctacttcgatctgaagtctagaggagacaagtatggcaaattggtcggcgtggtccctggtccagtcggagagccagcggactctgacaagcgtcatgccagtgacttcgccctgtggaaggcggccaaaccccaggaggtgttctgggcctctccctggggacccgggaggccgggctggcacatcgagtgctctgccatcgctagtatggtatttggaagtcaactggatatccattcaggtgggatagatttagcttttccacatcatgaaaacgaaattgcacagtgcgaagtctttcatcagtgcgagcagtggggaaattattttctgcattctgggcatttgcacgccaaaggcaaagaagaaaaaatgtccaaatcattaaagaactacattactattaaggactttctgaagaccttttcccccgatgtcttccggttcttctgcctgcggagcagctaccgctcagccatcgactacagtgacagcgccatgctccaagctcagcagctgctcctggggctgggctctttcctggaggacgcacgtgcctacatgaaggggcagctggcctgcggctccgtcagggaagcgatgctgtgggagaggctctccagcaccaagagggccgtgaaggcggccttggcagatgattttgacacacccagggtggttgatgccatcctgggccttgcacaccacgggaatggacagctcagggcgtccctgaagaagcccgggtctgcc

SEQ ID NO: 7303 - DNA, 963 bp, Homo sapiens
gtccaaaccatgggaggctcctctcctagaccctgcatcctgaaagctgcgtacctgagagcctgcggtctggctgcagggacacacccaaggggaggagctgcaatcgtgtctggggccccagcccaggctggccggagctcctgtttcccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 7304 - DNA, 2930 bp, Homo sapiens
gacagggccgcggacgcccgggcagccacggcggcggggccgcggcgggcgccggctcagcccgcccctttctcccgccgcctccccgccccgccccgcgccgcgccggccgctgtcagctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgcta

SEQ ID NO: 7305 - DNA, 950 bp, Homo sapiens
agctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgaggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgagatttgtattgaacgatgtcttgagaggggaaagagtagtggtaggagtgatgacaacagagagagcttggaaaagagaattcagacctaccttcagtcaacaaagccaattattgacttatatgaagaaatggggaaagtcaagaaaatagatgcttctaaatctgttgatgaagtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgc

SEQ ID NO: 7306 - DNA, 2042 bp, Homo sapiens
cgtcgctgaggcgcccatggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaagtaggtgtcccagtgcaatgcaatgtgagcggcaggcattcctgaagggagatgaaccactggcactggctttaggattgtgaggaagtgatattgtttccagttttcaaacacaagagacaacatcctctaagttacttcagccccttccaatgggcttgtcaccacagggctgcagcattgttatcttaaagcaaaggtcatcggactagggatcagaccctgccactgatcctggctgtgctaggagcagctgcacctgggtaagacagtaagtgtctctgtgcctcagtttccccagtcatagtataatcacacagagcactagataacgagctcatagtaacatctacctattagatgcttcccgtgtgtcaggcattttactgatgttatgtcatccttgtgaggaaaacattagccgtattttacagtttacaactttaaggctcaaaggattaagtgatttgtctaaatgtacataactattcactagtaaaaccgggattaaaatctttctgattttgcagccagtgtttttgttttaattagaaagttataaacacgactgcagaagagagtctggccaggcctcctgcctcatgactgagtatgaatcagttctacaccactgcctttaaaaactgaagcagaaatattttctctaactgaacaatgatagccctgttatcataacatagtaatgttataaataatggtagctgctgtgggtaaagatattatgttaagcaatttacttgtattaattccattaaacttcagtgaacatttgcaaggaa

SEQ ID NO: 7307 - DNA, 2884 bp, Homo sapiens
atggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctatataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaatcta

SEQ ID NO: 7308 - DNA, 1210 bp, Homo sapiens
gtttcccgctggcgcctggctccctccgggtttcgtttcccgccggcgcctggctcccgccaggtttcgtttccgaggcggggccgagggcggcgtcgctgaggcgcccatggccttcgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtcccagctgggaggaaccttataccatccttctctccacctgctcggcagtgaagtttgtgggactggaatcttggattcatcacactcgagtcaaggcctggaatga

SEQ ID NO: 7309 - DNA, 1787 bp, Homo sapiens
gggggagggggcggggcgagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggccagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttggaaatgaagtgtctgatgaagagtgcttgaagagagtgggcctaagtggcgctcctgctgatgcctgttctactgcccagaaggctgttggatacatttgcaaatgtaatggtggccgtggtgccatccgagaatttgcagagcacatttgcctactaatggaaaaggttaataattcatgccaaaaatagaaattagcgtaatattgagaaaaaaatgatacagccttcttcagccagtttgcttttatttttgattaagtaaattccatgttgtaatgttacagagagtgtgatttggtttgtgatatatatatattgtgctctacttttctctttacgcaagataattatttagagactgattacagtctttctcagatttttagtaaatgcaagtaagaacatcatcaaagttcactttgtattgtaccctgtaaaactgtgtgtttgtgtgctttcaaagatgttgggattttatttatctggggacagtgtgtatggtaagacatgcccttctattaataaaactacatttctcaaa

SEQ ID NO: 7310 - DNA, 687 bp, Homo sapiens
cgcgcctagcagtgtcccagccgggttcgtgtcgccatggggcagatcgagtgggccatgtgggccaacgaacaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagtacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggtggcggcggggggacccccgggaggtccccaggtcaaccccatcccggtgaccgacgaggtcgtgtgacctcgccccggacctgccctcccgccaggtgcacccacctgcaataaatgcagcgaagccggg

SEQ ID NO: 7311 - DNA, 4324 bp, Homo sapiens
ttcctcattggaagaagaagcatagtatagaagaaaggcaaacacaacacattcaacctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttc

SEQ ID NO: 7312 - DNA, 1608 bp, Homo sapiens
caacctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcat

SEQ ID NO: 7313 - DNA, 1822 bp, Homo sapiens
acattcaacctctgccaccatggggaactgggctgtgaatgaggggctctccatttttgtcatttcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatgg

SEQ ID NO: 7314 - DNA, 860 bp, Homo sapiens
gactccagtgacccggcgggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggtccctggtcggcagagggcgctaccctactgagcaattctgcgcagttccactaa

SEQ ID NO: 7315 - DNA, 1254 bp, Homo sapiens
tgagactccagtgacccggcgggaggagaggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcagaca

SEQ ID NO: 7316 - DNA, 579 bp, Homo sapiens
gagcggcccccggccaaccccagttcgacgacgtgttgggcgtctcactccgggtgggttccgcggcggggtgtatttatggagtattgaagaaatatctccgtcgggacggccggaaggaaagaggccagaggcgcggaggccggctagagccgggaacgaacgacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatctttt

SEQ ID NO: 7317 - DNA, 1338 bp, Homo sapiens
ggcaactttccctgtcgggcttgagttgggagaggagcagggcggccttgtagggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggtccctggtcggcagagggcgctaccctactgagcaattctgcgcagttccactaacaccaggccacaccctgccggacaactccagctggctgtactgattcacacacctcggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagcagaca

SEQ ID NO: 7318 - DNA, 611 bp, Homo sapiens
gaatgaatatattcgcgcgctctttgcagctgcctgaattcttccttccccagcatccccctccgcccggtcacccagacggccttctccagccttgccgagcttaagacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactg

SEQ ID NO: 7319 - DNA, 872 bp, Homo sapiens
agggtaggcgcccatgaggtatgtcgaatgaatatattcgcgcgctctttgcagctgcctgaattcttccttccccagcatccccctccgcccggtcacccagacggccttctccagccttgccgagcttaagtaagctgaggggcgctcagtgtggcagctctgcgtgtgcagggaaggggccaggatgcagaggggcagcgcaggagcgaggacgccacggctcagcgccccgccagcctcatgatggagcgctgccctgggggcagggctgacccagagccagcggctcgacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaagg

SEQ ID NO: 7320 - DNA, 1658 bp, Homo sapiens
attcgcgcgctctttgcagctgcctgaattcttccttccccagcatccccctccgcccggtcacccagacggccttctccagccttgccgagcttaagtaagctgaggggcgctcagtgtggcagctctgcgtgtgcagggaaggggccaggatgcagaggggcagcgcaggagcgaggacgccacggctcagcgccccgccagcctcatgatggagcgctgccctgggggcagggctgacccagagccagcggctcgtgagtgagagccccccgaccacggcccttctcggggagcgggccagccgccggggtcccagcctgcggggtccgcccgcgcttttgtcctcccgggcgtgcgtgtccgggtctcggccggttccccgtcggccaggcggagctgcggggcgacgccacgagtctgcgggcccgcggcggggagcggcccccggccaaccccagttcgacgacgtgttgggcgtctcactccgggacccgtccctgctcctgaccatcaccgtcactggggtcactgtgctcgtgttggtcctgaagagcatgaactccaggaggagagagccaatcaccttacaggaccctgaagccaagtacccgctgcccttgattgagaaagagaaaatcagccacaacacccggaggttccgctttggactgccttcgccggaccatgtcttagggcttcctgtaggtaactatgtccagctcttggcaaaaatcgataatgaattggtggtcagggcttacacccctgtctccagtgatgatgacagaggctttgtggacctaattataaagatctacttcaaaaatgtacacccccaatatcctgaaggtgggaagatgactcagtatttggagaacatgaaaatcggggagaccatcttttttcgagggccaaggggacgcttgttttaccatgggccagggaatcttggaatcagaccagaccagacgagtgagcctaaaaaaacactggccgatcacctgggaatgattgctgggggcacaggcatcacacccatgttgcagctcattcgccacatcaccaaggaccccagtgacaggaccaggatgtccctcatctttgccaaccagacagaggaggatatcttggtcagaaaagagcttgaagaaattgccaggactcacccagaccagttcaacctgtggtacaccctggacaggcctcccattggctggaagtacagctcaggcttcgttactgccgacatgatcaaggagcaccttcctcctccagcgaagtccacgctcatcctggtgtgtggcccgccaccactaatccagacggcggctcaccctaacctggagaagctgggttatacccaggacatgattttcacctactaacacctccacgtgctcagcaattttgcatgtcccttttcatctgtttcagagtaagttcaatttcaccacggtaaactgggatgttttcaaaagtgccttgccatgtaccttcgcgcacacactggttctcctcttttgggtgtgggcctaacaaaaagggctcaaggggctggagactggctgctggggcctccttgcttggaggctggaaagagctccatttcagtatctttctccgtggttttgtgaaataaactcaagtacaaagca

SEQ ID NO: 7321 - DNA, 2124 bp, Homo sapiens
gaggccaccgtcccgcgcggggcagcacagcggcgggagagctcggagcgcagagggccgcatccccagttcccagtctccatccccggcagaagcaggcggagcgacccggtccccgcccccgcgcccgccccgccccgcgcgcccgcctggcccctcggccccgcccctgctccggagtgacgcgggcccgggcgcgacggtctcggcggcggcggcggcggcgacagagcgagcgcggcgcggggccaccatgggggcccagctcagcacgttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaaccctt

SEQ ID NO: 7322 - DNA, 2938 bp, Homo sapiens
atgaataggagtttgctggttggatgcatgcagagcaaggacatttggggcagagaggagagcatatgcgaacgcctgaagcaagatgggcttgatgttgaaagagcagagagctgggagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaacccttctctagctcctcgagggtctgtgacctgcaacacaaggggtggggtcaggaaagggctggggaagacctagcattttttttttcttttttttttttttttgagacggagtctccctttgtcacccaggctggagtggcatgatctcagctcactacaacctccacctctcgggttcaagcgattctcctgcctcagcctcccgagtagctgggactaaaagtgcccaccaccacacccagctagtttttgtatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggctccagcatttatttctgatgtatctttgtggtagaaaatttggaaagtgcagagaagtatacacaggaagaaaaattcccaacccccagaggcaaaccagctgaaaccacgcaaccccagtcaccccaatgcaccgcgaggctgctgcctcctgtcagggtcagatgagcctcgaggctcaggaaagtcagaggatgccatctgcatggtggtaaattacagaggtgatgaggcaaggtgggtgtggggctgttcttaaaacggggcagcaggaaggccccaaggagatggatttgggctgggacgggaagagagagctggccatgctggggtgggtgggtgttcaaatggtggaaacagcagacgcaaaggccctgccgttggaaccagcttgtggaataaactttcagaaacaga

SEQ ID NO: 7323 - DNA, 2922 bp, Homo sapiens
agccacactgggaaaacattggagcttggtctgccatcctgaactgtggttcccctgcctcccagcccggctgtgagtgctcagcgaccctgacaggctgacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaaaaaaaaaagtaaaactttgctaatattaacccttctctagctcctcgagggtctgtgacctgcaacacaaggggtggggtcaggaaagggctggggaagacctagcattttttttttcttttttttttttttttgagacggagtctccctttgtcacccaggctggagtggcatgatctcagctcactacaacctccacctctcgggttcaagcgattctcctgcctcagcctcccgagtagctgggactaaaagtgcccaccaccacacccagctagtttttgtatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggctccagcatttatttctgatgtatctttgtggtagaaaatttggaaagtgcagagaagtatacacaggaagaaaaattcccaacccccagaggcaaaccagctgaaaccacgcaaccccagtcaccccaatgcaccgcgaggctgctgcctcctgtcagggtcagatgagcctcgaggctcaggaaagtcagaggatgccatctgcatggtggtaaattacagaggtgatgaggcaaggtgggtgtggggctgttcttaaaacggggcagcaggaaggccccaaggagatggatttgggctgggacgggaagagagagctggccatgctggggtgggtgggtgttcaaatggtggaaacagcagacgcaaaggccctgccgttggaaccagcttgtggaataaactttcagaaacaga

SEQ ID NO: 7324 - DNA, 1050 bp, Homo sapiens
tctgccatcctgaactgtggttcccctgcctcccagcccggctgtgagtgctcagcgaccctgacaggctgacaggaccaggagggaggtgccgctcagattctggcaggaccgctggcgggcaggcaggggacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgc

SEQ ID NO: 7325 - DNA, 1849 bp, Homo sapiens
aaaggcaggctcctgcactgaccccgcgggtcctgtcgtttcagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcattt

SEQ ID NO: 7326 - DNA, 2153 bp, Homo sapiens
aaaacattggagcttggtctgccatcctgaactgtggttcccctgcctcccagcccggctgtgagtgctcagcgaccctgacaggctgacaggtacagtctgccgggctttcctactgtccctggcagccccatgcttactctgcggcccagatcccagctctgtgtccacctgttccttctcctgggttcccttcccccacagttcccagccaagccagagccccccactgcagaacttcctccactccctcccacttcctcccggttagaacaggaccaggagggaggtgccgctcagattctggcaggaccgctggcgggcaggcaggggacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcaggacagtgaagtctgtgggcatgatcgcgggagggacaggcatcaccccgatgctgcaggtgatccgcgccatcatgaaggaccctgatgaccacactgtgtgccacctgctctttgccaaccagaccgagaaggacatcctgctgcgacctgagctggaggaactcaggaacaaacattctgcacgcttcaagctctggtacacgctggacagagcccctgaagcctgggactacggccagggcttcgtgaatgaggagatgatccgggaccaccttccacccccagaggaggagccgctggtgctgatgtgtggccccccacccatgatccagtacgcctgccttcccaacctggaccacgtgggccaccccacggagcgctgcttcgtcttctgagggccgggcacggtcacacggccacccgccccgcgcaccccacgccctgttcacgctcacccagtcacctccccacatcgcacactggggccccgggttcagcctggcctgcccgtgccctggtgaatcacctggctgagcagttcccctggagccccttcgggagcagggctgtgtcccagatgggccacggctgagccttcagagtacgtcctgcctggcacttactggtccttaccagagacgcccagccccatccctgtcctcatgacccctcgtccaccccccacacacactataaggctgagggctgccagcagccccgtctgcccaccattcccggccgtggaccatagtcgggatgtcagcagacacacatgggcagcccaaagctgcaggtgccagggcccaccccagcctcgcctgtcacccccactcccgcctcagggccaggcccaggcctcaccacctgacgctgcatgagacattgacaccagaaagccctcttgggggcactgctccctaccccagggccctggccagccgggagcttggctctcctctggctagagtgggaagagggggctggccatggggccctcccagaacctcagcatttccttccagcccatccaaacactgaggcagccttggggaaccccgagctggggggttggcagcccactgcaccgcctcagggttttggggtcctgggctggggccaccatccctgatggcagaactcccacaaccacatgtatttattcctctgtcctaaaccgtcccctccttccctcacccccagcacagggggattctgagcagtgcctcttgtctgagggacatatcagtgacctcgacgttgcctttagactacagttgtgttagcctcttgcgtattggctttttcagagtcatttatgagcagaaa

SEQ ID NO: 7327 - DNA, 675 bp, Homo sapiens
atctaagacatgcaggccccatgggaggcctctcccaacactttgtgggatccaggccaggggttggccctggagtctgccagccacactgggaaaacattggagcttggtctgccatcctgaactgtggttcccctgcctcccagcccggctgtgagtgctcagcgaccctgacaggctgacagttgggccatatggtgctcttcccagtctggttcctgtacagtctgctcatgaagctgttccagcgctccacgccagccatcaccctcgagagcccggacatcaagtacccgctgcggctcatcgaccgggagatcatcagccatgacacccggcgcttccgctttgccctgccgtcaccccagcacatcctgggcctccctgtcggccagcacatctacctctcggctcgaattgatggaaacctggtcgtccggccctatacacccatctccagcgatgatgacaagggcttcgtggacctggtcatcaaggtttacttcaaggacacccatcccaagtttcccgctggagggaagatgtctcagtacctggagagcatgcagattggagacaccattgagttccggggccccagtgggctgctggtctaccagggcaaagggaagttcgccatccgacctgacaaaaagtccaaccctatcatcagga

SEQ ID NO: 7328 - DNA, 768 bp, Homo sapiens
gcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaaggcaaactctggcacctgtagagctgaggatggagatagacaccaggacctatagtgggctgagacattactttcaaagatttcttttactgtcacagcactgtgagcaaggacaagacatctattgaatgggctgcctgccagttggaagttcaacttttgtaaagtcagtcaaagttctttcttctagaagcctcagtttcctcattggtaaaatggagacaatttag

SEQ ID NO: 7329 - DNA, 2255 bp, Homo sapiens
tgcgtcagaatgcgcctcacccctggcgaccccggaagtgggtcgggggcttggcctctgcccggccacagagccggagctggaggtgctgtcccgtctggcggcgatccccgggcagggcccggggccggggtttgaagatgctgaacgtcccttcccagtctttcccggcccccaggtcgcagcagcgtgtcgcctccggggggcgtagcaaggtacctttaaaacagggcagaagccttatggattggattcgactgaccaaaagtggaaaggatctaacgggattaaaaggcaggttaattgaagtaactgaagaagaacttaagaaacacaacaaaaaagatgattgttggatatgcataagaggtttcgtttataatgtcagcccttatatggagtatcatcctggtggagaagatgaactaatgagagcagcaggatcagatggtactgaactttttgatcaggttcatcgttgggtcaattatgaatccatgctgaaagaatgcctggttggcagaatggccattaaacctgctgttctgaaagactatcgtgaggaggaaaagaaagtcttaaatggcatgcttcccaagagccaagtgacagatacacttgccaaagaaggtcctagttatccaagctatgattggttccaaacagactctttagtcaccattgccatatatactaaacagaaggatatcaatttagactcaataatagttgatcatcagaatgattcctttagagcagaaacaattattaaggattgtttatatcttatacatattgggctaagccatgaggttcaggaagatttttctgtgcgggttgttgagagtgtgggaaaaatagagattgttctacaaaaaaaagagaatacttcttgggactttcttggccatcccctgaagaatcataattcacttattccaaggaaagatacaggtttgtactacagaaagtgccagttaatttccaaggaagatgttactcatgatacgaggcttttctgtttgatgctgccaccaagcactcatcttcaagtgcccattgggcaacatgtttacctcaagctacctattacaggtacagaaatagtaaagccatatacacctgtatctggttccttactctcagagttcaaggaaccagttcttcccaacaataaatacatctactttttgataaaaatctatcccactggactcttcacaccagagcttgatcgtcttcagattggagattttgtttctgtaagcagtcctgagggcaattttaaaatatccaagttccaagaattagaagatctctttttgttggcagctggaacaggcttcacaccaatggttaaaatactgaattatgctttgactgatatacccagtctcaggaaagtgaagctgatgttcttcaataaaacagaagatgatataatttggagaagccaattggagaaattagcatttaaagataaaagactggatgttgaatttgttctctcagcacctatttctgaatggaatggcaaacagggacatatttcaccagctcttctttctgaatttttgaaaagaaatttggacaaatccaaagttctcgtctgcatttgtggaccagtgccatttacagaacaaggagtaaggttgctgcatgatctcaacttttccaaaaatgagatccatagttttacagcataatgaagagctgtcattgtcctttattcaactagtttatctaaatttgtgattgcttagggttttttaagagaacatttttgtacataacaaaaggttaactagaatccagccttcagtttcttaaatgaaatcaaatgttccttcagtacaggtaacttcttggctttcttttgtaccacaacttattttactactgatatttgacctggaaagttaatcatggcaacaaatacatacaggattctttgttatgaatcacaaatttccttgccatttaaattatatcactgttctacaataagcacttgtgttttatgacatgataaagtaaatgatcacttcgatcatgtttctatgctgtaaaatgtcttattagcaatacagattaaattttaccttgcactgttaactcaggaaatgatcatttatgtccttgttattaatgttaaaacatagaatgttataacttattaagtgatccaaacatttttttgtgtgtgtatggcattgatgcagaatagaataaaattatacttaagttctttttaa

SEQ ID NO: 7330 - DNA, 363 bp, Homo sapiens
ggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccgaaacct

SEQ ID NO: 7331 - DNA, 834 bp, Homo sapiens
gcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagta

SEQ ID NO: 7332 - DNA, 777 bp, Homo sapiens
cccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgc

SEQ ID NO: 7333 - DNA, 776 bp, Homo sapiens
gcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccggaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 7334 - DNA, 4286 bp, Homo sapiens
tgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttcctttt

SEQ ID NO: 7335 - DNA, 4358 bp, Homo sapiens
gaaaagaaaacgaaccaggaactattcggaagtgtgattggctgttgctaggaaccgtctcaaggccttatgggccctggttacggaagccgaggaaggctgagcgcgggctctcaaggaaagtagtcgcggaatctcagttagcggtggagaggcagtatgtccggttcaatggcgactgcggaagctagcggcagcgatgggaaagggcaggaagtcgagacctcagtcacctattaccggttggaggaggtggcaaagcgcaactccttgaaggaactgtggcttgtgatccatgggcgagtctacgatgtcacccgcttcctcaacgagcaccctggaggagaagaggttctgctggaacaagctggtgtagatgcaagtgaaagctttgaagatgtaggacactcttctgatgccagagaaatgctaaagcagtactacattggtgatatccatccgagtgaccttaaacctgaaagtggtagcaaggacccttcaaaaaatgatacatgcaaaagttgctgggcatattggattttacccatcataggcgctgttctcttaggtttcctgtaccgctactacacatcggaaagcaaatcctcctgaggaggccttgctgaagttagaaagtgcatccactttggggcgaaaactagagacttgcttgggggctgcagaagtgccctctcctcgaatcctgccagttgcattcttcccccttggagccaagacgattggccagacatcacctcagatctgagaccagcgtcttccatctctcagagccttactcccaaagtacctgctcactgttccgtgttgaacaattgccggtgtttcctctcttcactggtttccatgagtacccttatatttcacaactttctgttcataagttatagtgacattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccctactcagcaattggttttggtttccaaatgacttctgcatttgtaaagataacagagtggtggggtcaaagtttatcttgtgtttagatctcttcaagactgcttaagcaaaaacaaaaatcccttggaacctatcgtttgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatcttattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcttgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttccttttct

SEQ ID NO: 7336 - DNA, 2981 bp, Homo sapiens
caccgcccagcccgccgcccggttgccatggcgacgccgtcgcgccacggcccgcagaaccggccaagcgacccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagc

SEQ ID NO: 7337 - DNA, 2984 bp, Homo sapiens
gggggacagcacttctttcagtacattttcctgttagactcggggtattagagacccaaagatacccaaggaggagtgagagcgtccctgccttcgaggagcagacagggcaccgcgaggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagc

SEQ ID NO: 7338 - DNA, 3151 bp, Homo sapiens
aggtgagccctgactgcgcagggagggacagcgcggggctcccgagtagcagccggcctcgcacctgccccttgcggccgcgcactggactgcggcgccgacccgcaccctgggcccgagggctgcagggctcgcccgccctctcggagccgagcctctcccggtccaggcggcccctgccctggcctgcccgggtgccgggtctctgctgaagttagaaccgagacccccgcttgctggtgaccccgagtttggatctttgctcctgcgccgcgttctagagcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctcaggctgggaggcagagggcacaaaccttataattttttaaatgaaaaaccgctgctgctggctgtggctagagccccctggggctgctggagctgctgcctctgttctggaggacgagccttctccttatctgctgcccatctttccaggaagtcaggatggagtcagaacaactacagtcatcccccgtggtgtctgcacatcactccagccccataaagagtgtcatgttagctgagtcaccatttggcttcggcctggaaatagtgtgattagaacactgatcgtgtgcgaggccaggagatcaagaccatcctgactaacaaacacagtgaaaccccgtctctactaaaaatacaaaaaaattagccaggcgtggtggtgggcgcctgtagtcccagctacttgggaggctgaggcaggagaatggtgtgaacccgggagatggcgcttgcagtgagctgagattgcactccagcctgggcgacaggctcaaaaaagaaaaaaaaaagaacaccgatcatgtgcttcttggatctggtgactgttctctccctgttttcctttctttttgggtgtttgaggagcatggcttagcttgagacacacacagacactgtgtacttcagtgaagggcttaatatacagtttccaaacctgacgactcttcttcttgtaatggctgcccttttcctacctgaggccgtcttagagaaaggggccagtctcctctaatgctcagatttcccatagttggcttttgctgtgtctcctgcctcaggcagtgtcatttctgggagcaggtggttgtagtccaggcccctccccagcagggtctgcccaggctccttcgagcccctttccccgcctcctctcagcctgtccggatgacagtgttcgcctcctgtttagactgtacactcttcaggggtaggggtgccgtcagttcttcaatcagctggcacacacttgtatagtgaaatgtttacatgtgggaaaactccgccttagacaaactaccaaagtacaatcgtgtctctctctagccggaatgctacagagagaaatggaaccttagatttgcaacaaaagtctgtaaactggtctgtttgccaaagtgaacactggatgactaaggagctgaagaaggcccccagaagcggatttgtggtgggttattttattttgcctgtggccaatcttctgtgaaatacaatgtgctgttggtgcaacagatgattcaataaatgtctacagc

SEQ ID NO: 7339 - DNA, 1496 bp, Homo sapiens
acccgggcgcggcgcggggaggctgaagggacgctcgggtaggcaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcaggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggacttcgggtgttcggtcctggtcgcagagcacagatctttaaagaagcgagagaggaggccccaccctcctggcagcagatgcctggggcaaggccaggggaaactgggggggcctcagggacaggcctggaaaggccacgatggctgctgaattcaaacaaggagtccctccagcctgaataacacgtggcacaaatgggcccggcctttggcagaggagcaagtgatatgatgtgtaaagtatgttggtggtgaaagcaaggttccccaggagaggggagggactggcccctgggaagctctgagatgaggctgtggcccagctgtagtcctgaccttcctcttctttaaccctttagccctaggatggctttggtgggagaggggatagaagcccatgacttcagacagactttctcttggcagatgcaggcgggcctcctcccaggctgctccagacatgggggttggggatggggggcaccttgcagccccttcctgctggggctccctccttgtagcaccccccttgcggctcagctctggtttcctctcccaggctcacccaggctctgctca

SEQ ID NO: 7340 - DNA, 1302 bp, Homo sapiens
gaccagccccttccttcccgtcaaggagcgcgcttgcctgtgtaactcacctgtaaagcccacccagggaaggccagggcctcatgaaacagaaaacaaagccgggcactgggcccttgagctcactagaatttggggtatctttccttgcaccctcaccgcatatggaactcctggcgtcgtgtcccaggtcacgcctgtccccgtggggaggctgggcccctccccccagccactcccgagacttgagacctctgcctcaggacgatggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtgatgcgcccggccggccctgggggttcgcggggtgtcttcttgcctgcccctgctgaggcgtcttcaggactgcaggctccggagagtggctctggcagcaggcgggcgcgtgggtgcagctgcatctgtttgagtgctgctttctggggtcaggtctccgcctcctctgcttctcctttctccgctgctatagaccagttcattgtgtgtggctcccgtgtctctgttgcccccttcagtgcagaaggctttgggtaggactt

SEQ ID NO: 7341 - DNA, 1225 bp, Homo sapiens
ggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 7342 - DNA, 1533 bp, Homo sapiens
gggtagacgtcgcacccggaagtaaagcggctccgtgacggagcggcggtgcgcgcggcagggcccggagtatcccgctttctttggaggaaaccaccgcatcagatctgcgctgcggcagaggcaggcaagtccctagcgtggaggggcagcatgctggcagcacttggggaggcggtgcgctaagggattcacgctgtaactgggaccgcagcagggaactacaatttccatagtgctccgcgccctcccagctggctctactgccggcgacggcgtggtacacgctgggatttgtagtcttacatggctttgcgcctcctacctggaaggcgggccagcgattggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaa

SEQ ID NO: 7343 - DNA, 1212 bp, Homo sapiens
ggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggcaaccttttctccagtgaggagtgaacagtgggcacctgagatcctggcccacgctactatgctttcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagt

SEQ ID NO: 7344 - DNA, 1309 bp, Homo sapiens
cagaggcgtccccacctcctgtgaacacttgtcagagacagcctcgaggcctgtgtcgctggggcacgcaagcttgccaatccctctgcccaatggcgcctgcgcagcgcgactcagaggcgtggctggggcgggggacggctcgtcccaggaagtcctgggtgggtagacgtcgcacccggaagtaaagcggctccgtgacggagcggcggtgcgcgcggcagggcccggagtatcccgctttctttggaggaaaccaccgcatcagatctgcgctgcggcagaggcaggctacaaccactagcacggctgacgatggccctttctgcggagaccgagtcacacatctaccgagctctgcgtactgcttctggcgctgccgcccaccttgtggccctgggctttaccatctttgtggctgtgcttgccaggcctggctccagcctgttctcctggcacccggtgcttatgtctttggctttctccttcctgatgaccgaggcactactggtgttttctcctgagagttcgctgctgcactccctctcacggaaaggccgagcacgctgccactgggtgctgcagctgctggccctgctgtgtgcactgctgggcctcggccttgtcatcctccacaaagagcagcttggcaaagcccacctggttacgcggcatgggcaggcagggctgctggctgtgctgtgggcagggctgcagtgctcaggtggggtggggctgctctaccccaagctgctgccccgatggcccctggcgaagctcaagctataccatgctacttctgggctggtgggctacctgctgggtagtgccagcctcttgctgggcatgtgctcactctggttcactgcctctgtcactggtgcagcctggtacctggctgtattatgccctgtcctcaccagcttggtcattatgaaccaggtgagcaatgcctacctataccgcaagaggatccaaccatgagctcttcccagcctaggggaagcctggatttgcccctccatgtaggagctgggcctagggacctgttgaactctctcagctgagtcaggggacacctcaggcactgggacagttgggcatttggaggcccgtgtgtgaattcctgctcctcatgctggagtgcctcccatttccttcccctttctctgtcatcccagaggaacataggcatcatgtgtctggatgaagctggggctgcaagactgcctctcctgcaaggcagctcatacttgtactgtatgttcagaaattttaggagagaaaaaagtaaaaaatttgtaaaaaa

SEQ ID NO: 7345 - DNA, 1054 bp, Homo sapiens
agagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgcaggaggaggagcggcggcggcagaacaagacgaccctcacttacgtggccgctgtcgccgtgggcatgctgggggcgtcctacgctgccgtacccctttatcggctctattgccagactactggacttggaggatcagcagttgcaggtcatgcctcagacaagattgaaaacatggtgcctgttaaagatcgaatcattaaaattagctttaatgcagatgtgcatgcaagtctccagtggaactttagacctcagcaaacagaaatatatgtggtgccaggagagactgcactggcgttttacagagctaagaatcctactgacaaaccagtaattggaatttctacatacaatattgttccatttgaagctggacagtatttcaataaaatacaggcttcaaagctgcacagagtctacgttttagagagttggcacctttgatgtggtagtgagctgatcatccactttcttctaaaataaagagaagaaaatggccagtattcatcctgtccttctctttccccattccttgataactctcttgtctttactgggaagctggagagtcacagtctagtagaagaaagattagaaaaatttcaactgtaggtgcctttgcaacctatcctgggagaccctaaaacatatttagttttagtgcctagagattttcactcctctaacatctctggatacagtgtccctggtcaacatgaagaagttacagaagaacgctttctgatcctggcccctaaagaatttacttgtgctaagtaataaaattcctattg

SEQ ID NO: 7346 - DNA, 708 bp, Homo sapiens
gcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcattgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaa

SEQ ID NO: 7347 - DNA, 693 bp, Homo sapiens
caggtccctccgcagcgggttctcagttgctcgctgggcagacccaggtcgcgctcccactgccgagcccgcgagatgctccccagagctgcctggagcttggtgctgaggaaaggtggaggtggaagacgagggatgcacagctcagaaggcaccacccgtggtggggggaagatgtccccctacaccaactgctatgcccagcgctactaccccatgccagaagagcccttctgcacagaactcaacgctgaggagcaggccctgaaggagaaggagaagggaagctggacccagctgacccacgccgaaaaggtggccttgtaccggctccagttcaatgagacctttgcggagatgaaccgtcgctccaatgagtggaagacagtgatgggttgtgtcttcttcttcattggattcgcagctctggtgatttggtggcagcgggtctacgtatttcctccaaagccgatcaccttgacggacgagcggaaagcccagcagctgcagcgcatgctggacatgaaggtgaatcctgtgcagggcctggcctcccgctgggactatgagaagaagcagtggaagaagtgacttgcatccccagctgtctccctgaggctccgccctggctgggagcctctggcggcccctcccctcccctgcccttaaccccagtaaagctccaaaaaaaaa

SEQ ID NO: 7348 - DNA, 712 bp, Homo sapiens
gtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtggtgttcccactgatgaagagcaggcgactgggttggagagggagatcatgctggctgcaaagaagggactggacccatacaatgtactggccccaaagggagcttcaggcaccagggaagaccctaatttagtcccctccatctccaacaagagaatagtaggctgcatctgtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccatagatggctggtcttatttcttacccgtattctttggtaggcatggaatatgcttattttgggaaaagctgtctgttaatgctagcttgccatccacttactgaaagtgtataaccagtgtatagtgcttagattaataataagaatagatcgacaacccgtaatgcaatgaatgggaccacctggtatga

SEQ ID NO: 7349 - DNA, 572 bp, Homo sapiens
acttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatga

SEQ ID NO: 7350 - DNA, 590 bp, Homo sapiens
tgggcgtggcttgaatgacttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 7351 - DNA, 435 bp, Homo sapiens
catcctcccttttggacgttggaggggccgcagcgtcatctccgatgcaccctcatcctcagataccgggtagagatctcgccggattcagcaccatggcggaagacatggagaccaaaatcaagaactacaagaccgccccttttgacagccgcttccccaaccagaaccagactagaaactgctggcagaactacctggacttccaccgctgtcagaaggcaatgaccgctaaaggaggcgatatctctgtgtgcgaatggtaccagcgtgtgtaccagtccctctgccccacatcctgggtcacagactgggatgagcaacgggctgaaggcacgtttcccgggaagatctgaactggctgcatctccctttcctctgtcctccatccttctcccaggatggtgaagggggacctggtacccagtgatcccc

SEQ ID NO: 7352 - DNA, 433 bp, Homo sapiens
agcacggttcgtttttcctttagtcaggaaggacgttggtgttgagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatac

SEQ ID NO: 7353 - DNA, 428 bp, Homo sapiens
acggttcgtttttcctttagtcaggaaggacgttggtgttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 7354 - DNA, 724 bp, Homo sapiens
tgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagggtctccctctgtcacccaggccgtagtgctgtagtgcgatcatggctcactgcagcctcaacctcccaggctcaagggatcttcctgcctcagcctcccaagaagctggcactataggcatgtgccaccacacctggctaacttctttatttttagtagagacagggtttcaccatattacctgggctgtgcttgaattcctgggctcaggcgatccgtccaccttggcctcccaaagtgttgggattacaggcgtgagccactgtgcctggcataattttggtattttttgatagtagccatcctaataggtatgaggtggtatcattgtggttttgatttgcatttccctgattatttgtgttcttgagcatcttttcatgtacttat

SEQ ID NO: 7355 - DNA, 571 bp, Homo sapiens
ttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaata

SEQ ID NO: 7356 - DNA, 828 bp, Homo sapiens
actgcatgggatcggtattaatctgtttgtctttttcatcttctgggctgtgagctcctagaagtcagctttttcacttttacccaagccaaacggttattcgcgtaaggttggttataattaaaatgtcggtttgtgcacatggtttgggactctgtgtatgagtacgactaatatcttcaatttactaagaagataaagaggtcgataaataaggaggtcaagcccgttttgcaaggtcacacaggaaagaagcagaccacgaaatgaacttcggctgtcacctgcggtgggcgcactagaggtcttttgaactccttcggctaccgtcgccgcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacagtaa

SEQ ID NO: 7357 - DNA, 566 bp, Homo sapiens
attctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacaccagcccaagaaaaaaggagaaaaatctttcctccacataaatcatctattcaacattaaactcagcactgaaataaaagctctgtttgcctagctc

SEQ ID NO: 7358 - DNA, 562 bp, Homo sapiens
ttctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacactatgatgattctccacagtacctgcctcaaacaaaaatacaagagaaggatcacagttgaagacagttcaacagcaaaagaaatctgcagtct

SEQ ID NO: 7359 - DNA, 694 bp, Homo sapiens
tttgcatccctaccccgacactgcgggttgtcacaacggcaccctcccgctttctctctgcctcggatttagtcgtgactgtgtgtctccgccgtggtgcagcttcaggcctctcccgcatctactctctcacgcttccgctgcggcctgagggagggcggcgggcggaccacggaccggggtgggttgcgacggccccaccgaagccgggtgggctgcgggaccctcgagaacccagctggcttcggagtgagctggcccggggctggtacccgctgcgctttttcacagccattgtgaccttggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaa

SEQ ID NO: 7360 - DNA, 745 bp, Homo sapiens
cggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaaggtaatatggttatttgaagttacttaaaaaaaaatttctaattgtggtaaaatgcaaatacaggtgactgtccctcacaatgtttagacttaagattttttgactttacgatggtgtggaagtgatacacatttggtagaaaccatactttgaattttgatctttgtccacatgagcaataagtggcacaatacttttgtgatgtgggggagcaccaatgaccacatcccccagtcagaaacataatcacaagggtaaacagctgatgctgtactctgtagtgttgtgtgagatactcagtgttttattataagctaggctttgtgttagatgattttcttcagctgtaggctaacataagtgttctgagcacatttaaggtagggaaggctaagctatgatgtaagttaggtgtattaaatgcatttt

SEQ ID NO: 7361 - DNA, 513 bp, Homo sapiens
gcaggaggggaaggatgggcttcctgcaacctcccttgccccacggcttcccatcctacccccggccgcgttagctgaaggccagcagggacgcaaaagtttttaggccccttaggtctttaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaat

SEQ ID NO: 7362 - DNA, 762 bp, Homo sapiens
gttacagatacggaaacaggctcggaggtgcaatctctggctgtgtagacagaacagggagttggaacacggccttatgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 7363 - DNA, 389 bp, Homo sapiens
agtccttctgggtcctctcccttccaggaccctctaggcagcccggtcacccccaggccagactccagggcgagtcccctcccaacccagctggcagttcgcgggtgtcccaggcgctgatccgctccttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 7364 - DNA, 699 bp, Homo sapiens
agagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttgtgaaagc

SEQ ID NO: 7365 - DNA, 914 bp, Homo sapiens
aagtaccttattattccattgtcttaacactgactgacttctctatcttttcttgtgccttgacatctgtcttgagctctagatttttcattattaatctcttgagaaatgaaggttaataatgaattaacctaagttagtaaggcccaagcagcaatcattccacacaagcctgggtttaataaggtcaaaacaggaataatctcacaccaacctgagatttcttacattcctcattactgtgaatggtatagccaaccaccttgaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttgtgaaagcaa

SEQ ID NO: 7366 - DNA, 773 bp, Homo sapiens
cagccttagctccagggaccagcctactgaacatcgaaaaggtcaggaacgagatcacgggactgagacggcgagccggctagagcggatagagccgtactgccgctctagtttttcttttgctctctatggttaggagcgcaagcctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccatgctttgtctgattttatcactttatgccaataatttcaacttttggtcagccttgtaaatcttaggtaaggatcaaagaaatgattcttttgccactaaacttg

SEQ ID NO: 7367 - DNA, 1112 bp, Homo sapiens
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatg

SEQ ID NO: 7368 - DNA, 3056 bp, Homo sapiens
agaatggtaaacacagcagcagagctaccacacacttcccttctgggagcggtggggaaagcagccagggaggtcgggagatggacggaaactgctggggatgtgagaagcctggggcactaactggagttgttattgacttggttgccaggggaagcttggccgacaagtctatactcctgggcagactgagcaacagcaggtggtggcttctggataagaggtgctctaggtcggaaggaaataaatgagactacgatcagttaaagttcggtaaagcaagagacgccttcaacccgacgaccagacggtggctccgcagcacagactctctcggatggtggaattcccaaccggcttcgatgtagccccgcccctacccagaccacgcccaccaatcaccgccctctcccccccaggccccgcctggagcccgcccctcctaaagcatgctccacctgactccgacactgccgggcttagtccgccgggcttagtccgtggagcgcttgcgcatttcttgagttgtcgtggcactgcccaaatctgaatgggggaaagagggaacttcatatttcctacagactccgccacagcgactttgcgtgctctcttagagctggttttgcctttcgtggtcctgagaaccctggcttttggttccccaatgcggcttaagtgtgcaggttttaagttaggcgatcttcgggcagccctagtcccagcaccgggtccttgcgctgagtctcgggaccacagccggggaggcggggtccttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatgagttaggctgcagaggactggtttgttttttggcataaaccctttgaagttcctttttcattgttaaattaaaatttttttttttacttggatggcttaacatttttgcaagaaaaataggaagatatgaagatgatgttttggtttgtttatgaaatgcatatggcttgtcagagctcattcgacagttaaagccattgtttaaagaaatggtgctttgctctgtgtttgtgctcctgatttccctggaggttctggatgaaggctgaacacaggcttgttaatgtcagtctgtgctgaggacctcagggacttgaggttgcatttttgagcatggggtgcaggagcctttctggatttggatgtggctatggaaagaacacagaagccaaggtcatgtgcatgaaatgaggagtttgagttagtcacctcggggattttttccattttgcagtaaaatgttaaattaatgtagcctgcctctatttgttgggcaggtaatttcaaagggttatttgcctcatctcctatctttagtgaaatcttatgtgtaattattccaccgtgggaacagagaatacctgtttagtgttgcactttagactggtgtctgttttgttaatgcagctgtgccacaaattctcctttatcttttaaaaatgttatagctttaaattttgatttattttgactgtggaataaatacatgaatgaaaaattttaagtttgaagttctttgaatgacctttcagagtaatttcagaacaccagcagcatcttaaacctgagtctaatttctttcttgttaattaggcaccagataatctttataaaatggttcttaaaagtctagtaataggagtcttaatggcatattgatgattaccacatggttttttataaaaacctgcctgccccttagtgaaaggtacctgtaactcacagttcatttagacactaatttcctttgctgtcatgattggtagacttcacttaccctatattaattttgaaaaaaggtggaattttattatatatgaaggaatagtttgtatcttaccatagcacagaacagtgacctcttgctcaggataagatgtggtgatttgaaaatactcaatagtagccttgcagtgatatctctctctctctctctctgcaaatctaaattttattctctggtatttcctccaagtttttattttgaaaattttcagactacagaaggactaagcatagtacaatatacacctgtatatccttcacttagatcaccagttatcaatatattggcacctttgctttttcttgttctctcacacaggcacacacaatgcatatatgcacacacacatagatctgttttttgttgagtcatttaagattgttagggaattatgataaatcagccatagtactttagcaggtatcttctgagtaaggacatgtgttcctttataaccataatgcagttgtcagactcaataaagttaacatttataacaatactaccatctaatacatagtttactttcagatttccccaggtgttctaataatgagttcttcatagttgtgtttttaaaaaataacagctttattgggatataatttacatactgtacagttcacctcaagtgtacaattcattggtttttactgtatttggagttgtacagccaccatgagaatcaattttagaacacttatatcaccctaaaaagaaaccccatacccattagcaatcacttgccttccctcccaccatcccaactcccacctcctagcccaaagcaagcactcatctactttcagtctctatggatttgtctttcctggacatttcatataaatataatcatatgatgtgtgatgtacgtga

SEQ ID NO: 7369 - DNA, 489 bp, Homo sapiens
gtgatcatcttttctttgacattggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatcttt

SEQ ID NO: 7370 - DNA, 542 bp, Homo sapiens
ggctgtaaaacggaaaggttcggaatttgcctctgcgccgtctttttttgcctgttacctgtgacgtccttggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaa

SEQ ID NO: 7371 - DNA, 617 bp, Homo sapiens
atttgcctctgcgccgtctttttttgcctgttacctgtgacgtccttgaaaatgaaaagctttcttaagacaataggacgggccgggcgcggtggctcatgcctgtaatcctaacactctgggaggccgaggttggcggatcacgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatctttaaaaa

SEQ ID NO: 7372 - DNA, 417 bp, Homo sapiens
tccaggctgtaaaacggaaaggttcggaatttgcctctgcgccgtctttttttgcctgttacctgtgacgtccttgatgattattcttttggctctttacaatgtagctaggaaaaatttgtctttgatgtgatataatatctgaatccctggaggaactacagtcatgcatcgctgaacagcaaggatatatgttctgaaaaatgcatcattaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccaga

SEQ ID NO: 7373 - DNA, 587 bp, Homo sapiens
ctttttttctattcttgttttagaaaatgaaaagctttcttaagacaataggacgggccgggcgcggtggctcatgcctgtaatcctaacactctgggaggccgaggttggcggatcacgaggaagcagaatctgaaactttctgaggagagcatttgagcttcagatttctaacagcctctttgcaacaaaatagaccagtagctgaaggcaactgcaatccttcatgatgtttcccttggccagaaatgcactaagcagtctcaagattcaaagcattctgcaaagcatggcaagacatagccatgtaaaacactcaccagattttcatgataaatatggtaatgctgtgctagccagtggaactgctttctgtgttgctacatgggtgtttacagccactcagattggaatagaatggaacctatcccctgttggcagagttaccccaaaagagtggaaacatcagtaaccatcacagttgctgtaatgacagaattgtttaaaaaaccaacttgtcatgtaagcactctactgcttattaaaatatagcacaattgaaaaaataaaatgtgttttaaatcttt

SEQ ID NO: 7374 - DNA, 666 bp, Homo sapiens
cgcgtttcctcaaggctccgccccatttcccatctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgtcaataaacttatgacgtgaatgcttaatgcctcttttttgaaatagggaatgtaataattggccatttgcctactttattatttgggtaacattccagtattactctctgtgatttagcttatttaatggtgttaaactgaggttatattaaatttttgattcccaggtcaggattttgttggtaatttatataataaaagggaaatacaaatcga

SEQ ID NO: 7375 - DNA, 1584 bp, Homo sapiens
gcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctctgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcagttcctccatttaacaggtagttagtggatttctaatcatgttaaagcaggcctttttattaagtagcctcttccccatcacccagaacacacacacaaatacattgttgtgtagggctgattcctgaggttatgtgtagatgtggcattggtggagactagttgtaaacctatataaaaatatttcaataatggccagtgtttattgaatactactgcttatcaggtacactttacatcgatatctcatgttctctagcaagcttgtgaggcggatgatagtaaccccatctgagacacagagatgttaagttgttcaacatctcataactagtataatggtggaccaggactcttgcccaggcagtttcttgttgcagaactcacacttttaaccaggtaaaactgataaactgattaatgttactctatcttgaacactgttactagaacagtagctgagaatgtgtcttttaaaacactataaacatttccatttcttttagaaagtggtcactgtgctcctagtttttaaattggcttacaatacttgtttaagttgtgaaaaatccctgaagataaaacccttctagtgctccttgatacataagtcccagataattatgcaattgtaaatctgtgcctcaccaactcagccatgttgggaaactcaaacttttaaatatactttcctcattaaggcagtggttcttaaatgaggatgattttacaacacaatggggcatttggcaatgtgagacatttttgatcgttccaacttgggggcaaaattaccagtggtgctgaggttgagaagccttgtgtcaaggggatatgttaatatatgctcaaaggagtcgttcatattggaaggttagcagatttgctgtgtgtggataaaatatttagcttaattgtcatcagagtttctcagagtaatactatagaacactaggatgattggaaagagtgtcatagtttagagggggaataacttatccaagctactaatgcggaaaggttgcggtgcatgtgatgaagcaaatcagtatgaatgaattcatgatactgtaaacgctttctgatgtactactcaaactgatagaaaatattttcatgaaactacatgatttctgttaaatgaatgggatttttaaaatgccattaatttctgtttttattttgcagatatgaagagcattttaagaggtgcagcctctggaagtggatcaaactagaactcatatgccatactagatatgtttgtcaataaacttatgac

SEQ ID NO: 7376 - DNA, 1240 bp, Homo sapiens
gctttcgcgaggttttgactctcgtggcgccccaggggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcgtcccgggcagctcccgctacggacacctcaggcagtggccttgtcgtcgaagtctggcctttcccgaggccggaaagtgatgctgtcagcgctgggcatgctggcggcagggggtgcggggctggccatggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgta

SEQ ID NO: 7377 - DNA, 1961 bp, Homo sapiens
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttc

SEQ ID NO: 7378 - DNA, 2018 bp, Homo sapiens
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggtgttttgctatgatttttgactgaaggtgaagggaagtgtgtgtgattagaaatttcatccattctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgct

SEQ ID NO: 7379 - DNA, 1075 bp, Homo sapiens
gctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggatttgtgcaacgaccagcaccatcaagatgcagacccattccgtcaccatgtggctccctcctgctgtcctacagtcacaacatggagtttgtctttttctctgacaggttctatatcagagcaaacttttatttatttgaggaggccaatgtattaatatttccttttatggattgttcttttggtgttaagtctgaaaatcctttgcttagccctccttcctacattgctttttctaagagttatatagtttaacactttacaaaatgtaactctattacccattttgtgttaatatttgcataagttatgagatttagatcaaggttcattttctgtggactatggctgtccaaatgttccaacaccattttggaaaggtaggcatattgtcaaaactcagctgagtatattttgtgaatctatttcttattgtttactcctccactaataccacactgtggtgactctagtagctgtacagtaactcttaacatcatatagggcaattctttccactttattgatttatattttcagaatggctttagcttttcttgtcccttgcctttccataaaaattcagaataagcttgtaagtgtctacaaacaaacctgccataattttgataagaattaaagcagaggtgtccaat

SEQ ID NO: 7380 - DNA, 2983 bp, Homo sapiens
agaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcc

SEQ ID NO: 7381 - DNA, 1455 bp, Homo sapiens
atgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttag

SEQ ID NO: 7382 - DNA, 2685 bp, Homo sapiens
atctcagctcgctccagggaaggaggcgtggccacacgtacaagcccgcctataaaggtggcagtgccttcaccctcaccctgaaggtgacagttccttggaaccttccctgatccttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 7383 - DNA, 2608 bp, Homo sapiens
ctcaccctgaaggtgacagttccttggaaccttccctgatccttgtgatcccaggctccaagagtccacccttcccagctcagctcagtacctcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttcccaagttgtgcttgagccaggaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaagggaagagacagcccaggatactggcacagaggtagtctcactgcttgaactaggctgagcaatctgaccctatgggtctaggacacagttcctgggaacatcacattcctctgcccttcctgcaggcaggaacaaacagggctgccttctggccttgtaagacccttattgctgtcctggaggggctggggacttgtgtctgcggggatcagagcgcacagggagtgcacatatccaggcaccaggactagggctggagtgaggggggggtatttcaattaccttctattggtctcccttctctacactcttgtaataaaatgtctatttttaatgtttgtacacaacaatccttctattctagcctgcattgagcttgcatgcttgcataagagcttaagaaccattgatttaatgtaatagggaaaattctaacccaggtatccaaaaatgtgtaagaacaactacctgagctaaataaagatattgttcagaaatccta

SEQ ID NO: 7384 - DNA, 1594 bp, Homo sapiens
ttgtgatcccaggctccaagagtccacccttcccagctcagctcagtacctcagcagccacctccaagatccctacactgatcatgcttttcccaatctccatgtcggccacggagtttcttctggcctctgtcatcttctgtctggtattctgggtaatcagggcctcaagacctcaggtccccaaaggcctgaagaatccaccagggccatggggctggcctctgattgggcacatgctgaccctgggaaagaacccgcacctggcactgtcaaggatgagccagcagtatggggacgtgctgcagatccgaattggctccacacccgtggtggtgctgagcggcctggacaccatccggcaggccctggtgcggcagggcgatgatttcaagggccggcccgacctctacaccttcaccctcatcagtaatggtcagagcatgtccttcagcccagactctggaccagtgtgggctgcccgccggcgcctggcccagaatggcctgaaaagtttctccattgcctctgacccagcctcctcaacctcctgctacctggaagagcatgtgagcaaggaggctgaggtcctgataagcacgttgcaggagctgatggcagggcctgggcactttaacccctacaggtatgtggtggtatcagtgaccaatgtcatctgtgccatttgctttggccggcgctatgaccacaaccaccaagaactgcttagcctagtcaacctgaataataatttcggggaggtggttggctctggaaacccagctgacttcatccctattcttcgctacctacccaacccttccctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacaggaagctatgggtcaacccatctgagttcctacctgaacggtttctcacccctgatggtgctatcgacaaggtgttaagtgagaaggtgattatctttggcatgggcaagcggaagtgtatcggtgagaccattgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagacc

SEQ ID NO: 7385 - DNA, 3127 bp, Homo sapiens
gaagctccacaccagccattacaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagaacagtgtccgggacatcacgggtgccctgttcaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatg

SEQ ID NO: 7386 - DNA, 2664 bp, Homo sapiens
attgcagctgaacagggtggagggagcattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctgggacattggtgcgcgtgttcctctactctctgggtcgcaaccccgccttgttcccgaggcctgagcgctataacccccagcgctggctagacatcaggggctccggcaggaacttctaccacgtgccctttggctttggcatgcgccagtgccttgggcggcgcctggcagaggcagagatgctgctgctgctgcaccatgtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggtgttgggtcctctgcttcctgtgctgtcccctggggaaggtcccgaggatgctgtcaggagatggaagagtcatgtggggtgggaacctggggtgtggttccagaaatgtttttggcaacaggagagacaggattgggccaacaaggactcagacgagttttattgactcatttctctggttgatacggagccatgtcatgtgccacgacctggggtgggcacagggaggctgcagtttcctgcgtgaacctgccttgggcctcatctgctcctagcccagcagagagagttgacccctcctgaactggccactccccagtgctcccgtgcagggagaggaagcacccagtttgagagtgtacccagccagactgtctttatctccatggattttcatcagggcaaagatcacagcagccagctcc

SEQ ID NO: 7387 - DNA, 1874 bp, Homo sapiens
ggagcattggaatggcactcagggcaaaggcagaggtgtgcatggcagtgccctggctgtccctgcaaagggcacaggcactgggcacgagagccgcccgggtccccaggacagtgctgccctttgaagccatgccccggcgtccaggcaacaggtggctgaggctgctgcagatctggagggagcagggttatgaggacctgcacctggaagtacaccagaccttccaggaactagggcccattttcaggtacgacttgggaggagcaggcatggtgtgtgtgatgctgccggaggacgtggagaagctgcaacaggtggacagcctgcatccccacaggatgagcctggagccctgggtggcctacagacaacatcgtgggcacaaatgtggcgtgttcttgctgaatgggcctgaatggcgcttcaaccgattgcggctgaatccagaagtgctgtcgcccaacgctgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttggctctttttggagagcggctgggcctggttggccacagccccagttctgccagcctgaacttcctccatgccctggaggtcatgttcaaatccaccgtccagctcatgttcatgcccaggagcctgtctcgctggaccagccccaaggtgtggaaggagcactttgaggcctgggactgcatcttccagtacggcgacaactgtatccagaaaatctatcaggaactggccttcagccgccctcaacagtacaccagcatcgtggcggagctcctgttgaatgcggaactgtcgccagatgccatcaaggccaactctatggaactcactgcagggagcgtggacacgacggtgtttcccttgctgatgacgctctttgagctggctcggaaccccaacgtgcagcaggccctgcgccaggagagcctggccgccgcagccagcatcagtgaacatccccagaaggcaaccaccgagctgcccttgctgcgtgcggccctcaaggagaccttgcggctctaccctgtgggtctgtttctggagcgagtggcgagctcagacttggtgcttcagaactaccacatcccagctggggtgctgaaacacctccaggtggagacactaacccaagaggacataaagatggtctacagcttcatattgaggcccagcatgttccccctcctcaccttcagagccatcaactaatcacgtctctgcacccagggtcccagcctggccaccagcctccctttctgcctgaccccaggccacccctcttctctcccacatgcacagcttcctgagtcacccctctgtctaaccagccccagcacaaatggaactcccgagggcctctaggaccagggtttgccaggctaagcagcaatgccagggcacagctggggaagatcttgctgaccttgtccccagccccacctggccctttctccagcaagcactgtcctctgggcagtttgcccccatccctcccagtgctggctccaggctcctcgtgtggccatacaagggtgctgtggttttgtcccttgccttcctgcctagtctcacatgtccctgttcctcttcccctggccagggcccctgcgcagactgtcagagtcattaagcgggatcccagcatctcagagtccagtcaagttccctcctgcagcctgacccctaggcagctcgagcatgccctgagctctctgaaagttgtcaccctggaatagggtcctgcagggtagaataaaa

SEQ ID NO: 7388 - DNA, 2936 bp, Homo sapiens
ggaatggcactcagggcaaaggcagaggtgtgcgtggcagcgccctggctgtccctgcaaagggcacgggcactgggcactagagccgctcgggcccctaggacggtgctgccgtttgaagccatgccccagcatccaggcaacaggtggctgaggctgctgcagatctggagggagcagggttatgagcacctgcacctggagatgcaccagaccttccaggagctggggcccattttcaggtacaacttgggaggaccacgcatggtgtgtgtgatgctgccggaggatgtggagaagctgcaacaggtggacagcctgcatccctgcaggatgatcctggagccctgggtggcctacagacaacatcgtgggcacaaatgtggcgtgttcttgttgaatgggcctgaatggcgcttcaaccgattgcggctgaacccagatgtgctgtcgcccaaggccgtgcagaggttcctcccgatggtggatgcagtggccagggacttctcccaggccctgaagaagaaggtgctgcagaacgcccgggggagcctgaccctggacgtccagcccagcatcttccactacaccatagaagccagcaacttagctctttttggagagcggctgggcctggttggccacagccccagttctgccagcctgaacttcctccatgccctggaggtcatgttcaaatccaccgtccagctcatgttcatgcccaggagcctgtctcgctggatcagccccaaggtgtggaaggagcactttgaggcctgggactgcatcttccagtacggtgacaactgtatccagaaaatctaccaggaactggccttcaaccgccctcaacactacacaggcatcgtggcggagctcctgttgaaggcggaactgtcactagaagccatcaaggccaactctatggaactcactgcagggagcgtggacacgacagcgtttcccttgctgatgacgctctttgagctggctcggaaccccgacgtgcagcagatcctgcgccaggagagcctggccgccgcagccagcatcagtgaacatccccagaaggcaaccaccgagctgcccttgctgcgggcggccctcaaggagaccttgcggctctaccctgtgggtctgtttttggagcgagtggtgagctcagacttggtgcttcagaactaccacatcccagctgggacattggtacaggttttcctctactcgctgggtcgcaatgccgccttgttcccgaggcctgagcggtataatccccagcgctggctagacatcaggggctccggcaggaacttccaccacgtgccctttggctttggcatgcgccagtgcctcgggcggcgcctggcagaggcagagatgctgctgctgctgcaccacgtgctgaagcacttcctggtggagacactaactcaagaggacataaagatggtctacagcttcatattgaggcctggcacgtcccccctcctcactttcagagcgattaactagtcttgcatctgcacccagggtcccagcctggccaccagcttccctctgcctgaccccaggccacctgtcttctctcccacgtgcacagcttcctgagtcacccctctgtccagccagctcctgcacaaatggaactccccagggcctccaggactggggcttgccaggcttgtcaaatagcaaggccagggcacagctggagacgatcttgctggcagggcctggccttgtccccagctccacctggccccttctccagcaagcagtgccctctggacagcttgactctactcccagcgctggctccaggctcctcatgaggccatgcaagggtgctgtgattttgtcccttgccttcctgcctagtctcacatgtccctgtccctctcgccctggccagggcctctgtgcagacagtgtcagagtcattaagcgggatcccagcatctcagagtccagtcaagttccctcctgcagcctgaccccaggcagctcgagcatgccctgagctctctgaaagttgtcaccctggaatacgatcctgcagggtagactaaaaaggcccctgtggtcacttatcctgacacattttcaagtgatacaactgagtctcgaggggcgtgtgttccccagctgatcatgtcagcctcatgccccaggcctcgtctttcatggaccaggtcttgttcaagcagcgagtgttgggtcctctgcttcctgagctgtcccctggagaaggtcccgaggatgctgtcaggagatggaagagtcatgtggggtgggaacctggggtgtggttccagaaatgtttttggcaacaggagagacaggattgggccaacaaggactcagatgagttttattgactcattcctctggttgatacggagccatgtcatgtgccacgacctggggtgggcacagggaggctgcagttccctacgtgaacctgccttgggcctcatctgctcctagcccagcagagagagttgacccctcctgaactggccactccccagtgctcctgtgcagggataggaagtgccccagggtgagaacgtgcccagccacatcatctttatctcctgggattttcattagggcaaagatctcagcagccagctcctggtagctgatgaggatcagagcgtttgttcccccatgaaaggggaaatacttaggtaatcattccaggtgtgttcagtagttccaggactcagggactcaggccagtcaccctgtgaccgcaggttgctttcccaccctgggcaatgcagtgcagcatgggaaaggaataagggggcaacaaggtgcacagacctcagagatggcttccttgtttatggggctctcacagatacccatccaactcctctagtcagcactagatcatgggatcctaaaataaaccttggaaaaat

SEQ ID NO: 7389 - DNA, 1870 bp, Homo sapiens
atatgagctcaggcctggctgggctccaggagaatctttccacaaggcaagagataacacaaagtcaaggtgaagatcagggtagccctttaaaaggcctccttgtgccctagagttgccacagctcttctactccactgctgtctatcttgcctgccggcacccagccaccatgtgggagctcgtggctctcttgctgcttaccctagcttatttgttttggcccaagagaaggtgccctggtgccaagtaccccaagagcctcctgtccctgcccctggtgggcagcctgccattcctccccagacacggccatatgcataacaacttcttcaagctgcagaaaaaatatggccccatctattcggttcgtatgggcaccaagactacagtgattgtcggccaccaccagctggccaaggaggtgcttattaagaagggcaaggacttctctgggcggcctcaaatggcaactctagacatcgcgtccaacaaccgtaagggtatcgccttcgctgactctggcgcacactggcagctgcatcgaaggctggcgatggccacctttgccctgttcaaggatggcgatcagaagctggagaagatcatttgtcaggaaatcagtacattgtgtgatatgctggccacccacaacggacagtccatagacatctcctttcctgtcttcgtggcggtaaccaatgtcatctccttgatctgcttcaatacctcctacaagaatggggaccctgagttgaatgtcatacagaattacaatgaaggcatcatagacaacctgagcaaagacagcctggtggacctagtcccctggttgaagattttccccaacaaaaccctggaaaaattaaagagccatgttaaaatacgaaatgatctgctgaataaaatacttgaaaattacaaggagaaattccggagtgactctatcaccaacatgctggacacactgatgcaagccaagatgaactcagataatggcaatgctggcccagatcaagactcagagctgctttcagataaccacattctcaccaccataggggacatctttggggctggcgtggagaccaccacctctgtggttaaatggaccctggccttcctgctgcacaatcctcaggtgaagaagaagctctacgaggagattgaccagaatgtgggtttcagccgcacaccaactatcagtgaccgtaaccgtctcctcctgctggaggccaccatccgagaggtgcttcgcctcaggcccgtggcccctatgctcatcccccacaaggccaacgttgactccagcatcggtgagtttgctgtggacaagggcacagaagttatcatcaatctgtgggcgctgcatcacaatgagaaggagtggcaccagccggatcagttcatgcctgagcgtttcttgaatccagcggggacccagctcatctcaccgtcagtaagctatttgcccttcggagcaggacctcgctcctgtataggtgagatcctggcccgccaggagctcttcctcatcatggcctggctgctgcagaggttcgacctggaggtgccagatgatgggcagctgccctccctggaaggcatccccaaggtggtctttctgatcgactctttcaaagtgaagatcaaggtgcgccaggcctggagggaagcccaggctgagggtagcacctaaaggctgtaactcacagcccctgtccaccctatgtggccccacaacacagatttagagatacaaccccccacccttctccgccattcttccctactcccaacccactctgccttctttttcagcttgtggcaatgccagtgatgtgcataaacagtttttttttttccataa

SEQ ID NO: 7390 - DNA, 4409 bp, Homo sapiens
gcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggacaggaagaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagt

SEQ ID NO: 7391 - DNA, 4417 bp, Homo sapiens
ggacagggttcagggagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaataggtaaatatttgtcattgaatccattgccatcccatttgactgttcttttcatcctactgtctagtaataagctgagtataagatgacagtgtaatctccctgaaagcaggagctactttctttcttttgtaatctatttccatccccatttccctgtcctgtctccctgtattcactcccaagctcagttctgaatagacattcctgctcagagatactcccaactgatgcagaaaccaaataaagaggtaggtattccaagaattcaagaatggacattagtaaagaataaaacatttatttgagcttggaattatttggatcatctatatggcctaaaaatatatggactatgcctgtgtacctgaatacgtatgtagtcaggtcaagacaatcatccaaataacttagacccctaaaagcaaggccaggatttgcaatttaatgtgtcccaattaattcacttgaaaattagtaacactctgtttacgttgcctctggctggagctgcatggtggaagaagcccaactttggatccatgtacttcacccatccaatactcttgggacatttatgtgtattttatctgtatatatgaagccaatgtctatgtctacacagtcaaagtgaaatgcatgtttgatatagctgtacatagatatctattttgcaggtacaaaaatatcctgggggaaaactgggagtggaagggtggggggtgggagtgagggacatgggggagggacaggaagaggagaagtgttggtttgaacgatccaagcaaactctcccagaatcaaattacctgggtagttgttcaacttttcactctgcttagcctgtatagacaaaccccatatatttgtagaggcttggccttggaattctggaataccattggcttttcagtaggctgatgaacacattttgaaaattctattatcttcagaattttgccccattgttaagtgcttaaccgtcactcttgaatgtgcaatgtgctgtggattccattttcatcagttctgaaagaactgcaatgtgtaaattatcagtgaaatgcatgcatataagggctctatcattatcaaattgtaaggacaattgtacccttctatatctttgggcatgctagacacccccatgccttcattgagatcccattttccccctctcaagtggaaaataatcacatccagcaagctctctcattattgagaaataccatttggaaattgccactttttattcctaagcagcacctttcactgttcatgatgctaatgttccacaaaagcatgtgccattggcccactgaaggatagagggacccttttcaatctatatcagctgggctctgggactgaatctctcacctattcttgcagaaagacatactaattaaaccttgtcaaagta

SEQ ID NO: 7392 - DNA, 2388 bp, Homo sapiens
gagtttctggagggctgaacacgtggaggcaaacaggaaggtgaagaagaacttatcctatcaggacggaaggtcctgtgctcgggatcttccagacgtcgcgcggtgtcagaaaccctgtggtgaaattcagcctgtggattccagaaatttggagtgttcttggggggaaaaatccgcacacacaaagcaacatttggaaatccctgtggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaaggataggccttcattaacaaaatgtatgtctggttccccagtagagctctactgcctcaacccaaggggatttttatgtctggggcagaaacactcaagttgattagaaagaccaggccaatgtcagggtacctggggccaaacccacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttc

SEQ ID NO: 7393 - DNA, 794 bp, Homo sapiens
ggagtttctggagggctgaacacgtggaggcaaacaggaaggtgaagaagaacttatcctatcaggacggaaggtcctgtgctcgggatcttccagacgtcgccaactgatctcttagcaacaagaagcacctttataaaagatggcacacgaagagtgattgccagaaaagccacctggttcttaaacagccgcgcatcattagcaaaactcaccatcttcaagagtccaaaaactagaagtgaccagcagacccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaa

SEQ ID NO: 7394 - DNA, 1697 bp, Homo sapiens
ggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcacatgccattttctacattgctcttgtttaaacatttctaagtactcctcgtttttttccctagtgtttctgctttgttcacttataaaatataaatttccataaagtaggggccagcatctactagccttttgtatctttcctcattactctaggaaatagaattctacccacagttgaaacttaacaaatgtgattagttcgtttggttattaacatatcctaccaccaatcaactttatatatttaaccatttccagttgttcttttgggcatgatatatacatacatatatacatacatacccacacatatatacacacactcctccctcaaagctactaaacatgaaaacattgtgcctatatgataaaaatgtcaatattgctggtgatactgatgctgatggaaatgacgatattagctgccattaacgtagtatctaatgtgtgccaaacaatattaaaaattgctgtatatacatgtttgccatttattatttataaccttaacaagatgtctcactcataagactactttccgcactatgatacagaaatgaatattaaaacatgtgcatgctcatgtcaaactcatagaacttgattttattttggcaggattaaaccaatttgcaacttgagtacaaatgccaatatttcagctagttcttgaaaagttgtgccattgtgcaaaagtcattgaattatttgataactttttaacctaatgaccaaacacctgacaggaatggaattcactggacttgtatctaattgttttacactgttttctatgggttacattttttattgccattgtgacctttatccacacactaacctggaaagtataggaataaaagaattggcattctttctgataca

SEQ ID NO: 7395 - DNA, 1179 bp, Homo sapiens
ggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaaaaacatgatgctaaataa

SEQ ID NO: 7396 - DNA, 1442 bp, Homo sapiens
gggagtttctggagggctgaacacgtggaggcaaacaggaaggtgaagaagaacttatcctatcaggacggaaggtcctgtgctcgggatcttccagacgtcgccatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaa

SEQ ID NO: 7397 - DNA, 1062 bp, Homo sapiens
tcagggagtttctggagggctgaacacgtggaggcaaacaggaaggtgaagaagaacttatcctatcaggacggaaggtcctgtgctcgggatcttccagacgtcgcgaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaa

SEQ ID NO: 7398 - DNA, 1793 bp, Homo sapiens
actccactgtcagatccctctccaactcttcctgtgtgggatgatggcatttttcacagaagaagggggacatgttgatatggcctacaagcatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctgctcctgttcacacctgctagtgtgaattaaagtactttaattttgttttctgtggaggtggaaaagcaacattcatagtctttggagaaatgcttagaaattcagcatttgacccttgctgtgaattaagcccaattaattcctgtttgtctacatatgatctgtctgtggcaaaagtttaatcagaggaaattctttcccagtctgtcgatttatgcctcagccacttgcctgtgctacaattcattgtgttacctgtagattcaggtaatacaaactatatataatcatcaagtaatacaaactaatttagtaatagcctgggttaagtattattagggccctgtgtctgctgtagaaaaaaaaattcacatgatgcacttcaaattcaaataaaaatccttttggcatgttcccatttttgcttagctcaattagtgtggctaaccaagagataactgtaaatgtgacattgatttgctcttactacagcttcagtgattgggggaggaaaagtcccaacccaatgggctcaaacttctaaggggtactcctctcatccccttatccttctccctcgacattttctccctctttcttcccatgaccccaaagccaagggcaacagatcagtaaagaacgtggtcagagtagaacccctgaagtattttttaatcctacctcaaaatttaacagttacctgagagatttaacattatctagttcattgaatcattgtatgtggtcatggataaattgcacaccttggaattcgctttctaaaggaaatcaaatgaatggaggaactttccaaacaccactttacttgtgttatatagccaatataactatctctactgaatgtcattgaaaaactaaaaaattaaacttatttacaaatagg

SEQ ID NO: 7399 - DNA, 832 bp, Homo sapiens
cgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacggtactgaaattttcactctcacatcttgaccatctgtcctttactgaacaaggagctaggagggataacagaccaaaggaatcac

SEQ ID NO: 7400 - DNA, 1196 bp, Homo sapiens
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaa

SEQ ID NO: 7401 - DNA, 1032 bp, Homo sapiens
gaacacgtggaggcaaacaggaaggtgaagaagaacttatcctatcaggacggaaggtcctgtgctcgggatcttccagacgtcgcgtatgtatctcttaatctgactgagccctcaacctgtgggatcagacactctttccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattt

SEQ ID NO: 7402 - DNA, 592 bp, Homo sapiens
gaacgtgaccaactggagcctgacaggaggtccctggcactggtcagcccatcaaaccaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgc

SEQ ID NO: 7403 - DNA, 1958 bp, Homo sapiens
acattataaaacagtaagtgaatctgtactgtacagcaccctctgaagcaacaggagctatagatgaaccttttaggggattctgtaatttttctgtccctttgatttccacaggactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctggacaggttggaggaggtgaccaatgaatcgggctatgtggacgtgttgacccttctgcgtcgtgtcatgctggacacctctaacacgctcttcttgaggatccctttggacgaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatgctgatcgcagctcctgacaccatgtctgtctctttgttcttcatgctatttctcattgcaaagcaccctaatgttgaagaggcaataataaaggaaatccagactgttattggtgagagagacataaagattgatgatatacaaaaattaaaagtgatggaaaacttcatttatgagagcatgcggtaccagcctgtcgtggacttggtcatgcgcaaagccttagaagatgatgtaatcgatggctacccagtgaaaaaggggacaaacattatcctgaatattggaaggatgcacagactcgagtttttccccaaacccaatgaatttactcttgaaaattttgcaaagaatgttccttataggtactttcagccatttggctttgggccccgtggctgtgcaggaaagtacatcgccatggtgatgatgaaagccatcctcgttacacttctgagacgattccacgtgaagacattgcaaggacagtgtgttgagagcatacagaagatacacgacttgtccttgcacccagatgagactaaaaacatgctggaaatgatctttaccccaagaaactcagacaggtgtctggaacactagagaaggctggtcagtacccactctggagcatttctcatcagtagttcacatacaaatcatccatccttgccaatagtgtcatcctcacagtgaacactcagtggcccatggcattttataggcatacctcctatgggttgtcaccaagctaggtgctatttgtcatctgctcctgttcacaccagagaaccaggctacaagagaaaaagcagaggccaagagtttgagggagaaatagtcggtgaagaaaccgtatccataaagacccgattccaccaaatgtgctttgagaag

SEQ ID NO: 7404 - DNA, 993 bp, Homo sapiens
gggagtttctggagggctgaacacgtggaggcaaacaggaaggtgaagaagaacttatcctatcaggacggaaggtcctgtgctcgggatcttccagacgtcgcactccactgtcagatccctctccaactcttcctgtgtgggatgatggcatttttcacagaagaagggggacatgttgatatggcctacaagcatgtggaaaagctccctgagttccccgcctgccccacctgctgatttctcaggaccgctgataacagctttcatgtggaacttgggattaatatcaagcaagccatggattttgtctccactgaacttgggcatcatggacagtttccattccagcagttaagggcttcctgactttcaacagtggtgctgatcccagttctgaagagtggaacatcagagagcctcccctcctcagccacttgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagctctgtcaggccccggccttgttcgtatggtcacagtctgtgctgaatccctcaaaacacatctg

SEQ ID NO: 7405 - DNA, 872 bp, Homo sapiens
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccacggcagattcctgtggatggggatcggcagtgcctgcaactactacaaccgggtatatggagaattcatgcgagtctggatctctggagaggaaacactcattatcagcaagtcctcaagtatgttccacataatgaagcacaatcattacagctctcgattcggcagcaaacttgggctgcagtgcatcggtatgcatgagaaaggcatcatatttaacaacaatccagagctctggaaaacaactcgacccttctttatgaaagaaagtgctatcgtggttaaaatccaaggttattttgatgcatggcaagctctcctcatcaaaccagacatcttctttaagatttcttggctatacaaaaagtatgagaagtctgtcaaggatttgaaagatgccatagaagttctgatagcagaaaaaagacgcaggatttccacagaagagaaactggaagaatgtatggactttgccactgagttgattttagcagagaaacgtggtgacctgacaagagagaatgtgaaccagtgcatattggaaatg

SEQ ID NO: 7406 - DNA, 1747 bp, Homo sapiens
actgccaccatgctggcctcagggctgcttctggtgaccttgctggcctgcctgactgtgatggtcttgatgtcagtctggcggcagaggaagagcagggggaagctgcctccgggacccaccccattgcccttcattggaaactacctgcagctgaacacagagcagatgtacaactccctcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggcgtggcgttcagcaacggggagcgcgccaagcagctccggcgcttctccatcgccaccctaaggggttttggcgtgggcaagcgcggcatcgaggaacgcatccaggaggaggcgggcttcctcatcgacgccctccggggcacgcacggcgccaatatcgatcccaccttcttcctgagccgcacagtctccaatgtcatcagctccattgtctttggggaccgctttgactatgaggacaaagagttcctgtcactgttgcgcatgatgctgggaagcttccagttcacggcaacctccacggggcagctctatgagatgttctcttcggtgatgaaacacctgccaggaccacagcaacaggcctttaaggagctgcaagggctggaggacttcatcgccaagaaggtggagcacaaccagcgcacgctggatcccaattccccacgggacttcatcgactcctttctcatccgcatgcaggaggaggagaagaaccccaacacagagttctacttgaagaacctggtgatgaccaccctgaacctcttctttgcgggcactgagaccgtgagcaccaccctgcgctacggtttcctgctgctcatgaagcacccagaggtggaggccaaggtccatgaggagattgacagagtgatcggcaagaaccggcagcccaagtttgaggaccgggccaagatgccctacacagaggcagtgatccacgagatccaaagatttggagacatgctccccatgggtttggcccacagggtcaacaaggacaccaagtttcgggatttcttcctccctaagggcactgaagtgttccctatgctgggctccgtgctgagagaccccaggttcttctccaacccccgggacttcaatccccagcacttcctggataagaaggggcagtttaagaagagtgatgcttttgtgcccttttccatcggaaagcggtactgttttggagaaggcctggccagaatggagctctttctcttcttcaccaccatcatgcagaactttcgcttcaagtcccctcagtcgcctaaggatatcgacgtgtcccccaaacacgtgggctttgccacgatcccacgaaactacaccatgagcttcctgccccgctgagcgagggctgtgctggtgcagggctggtgggcggggccagggaaacggccggggcaggggcggggcttgtgggaggggcggggctaagaatgggggcagtgggggaaggaaggggagaggtggttagagggaacagaagaaacagaaggggctcagttcaccttgatgatgtccttcagagctgtgatgagaggaagggaaaccttacagtatgctacaaagagtagtaataatagcagctcttatttcctga

SEQ ID NO: 7407 - DNA, 1763 bp, Homo sapiens
atctatcatcccactaccaccatgctggcctcagggatgcttctggtggccttgctggtctgcctgactgtaatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaagggcagggccaagaccgggcttgggagaggggcgcagctaagactgggggcaggatggcggaaaggaaggggcgtggtggctagagggaagagaagaaacagaagcggctcagttcaccttgataaggtgcttccgagctgggatgagaggaaggaaacccttacattatgctatgaagagtagtaataatagcagctcttatttcctgagc

SEQ ID NO: 7408 - DNA, 2128 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggtgtcccaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 7409 - DNA, 2281 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 7410 - DNA, 3052 bp, Homo sapiens
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatctcggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagctgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgattttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcatgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtc

SEQ ID NO: 7411 - DNA, 1426 bp, Homo sapiens
acaaatgaggtgtatgctgactaacagccacccctggtgtggatgtgattggcagttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaaggagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatctcggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctg

SEQ ID NO: 7412 - DNA, 1901 bp, Homo sapiens
acacacacttaattagcatggagtgttataaaaagcttggagtgcaagctcacggttgtcttaacaagaggagaaggcttcaatggatccttttgtggtccttgtgctctgtctctcatgtttgcttctcctttcaatctggagacagagctctgggagaggaaaactccctcctggccctactcctctcccagtgattggaaatatcctacagatagatattaaggatgtcagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcgttggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctgaagaagcacagatggtctggctgctcctgtgctgtccctgcagctctctttcctctggtccaaatttcactatctgtgatgcttcttctgacccgtcatctcacattttcccttcccccaagatctagtgaacattcagcctccattaaaaaagtttcactgtgcaaatatatctgctattccccatactctataatagttacattgagtgccacataatgctgatacttgtctaatgttgagttattaacatattattattaaatagagaaagatgatttgtgtattataattcaaaggcatttcttctctgcatgttctaaacaaaaagcattattatttgctga

SEQ ID NO: 7413 - DNA, 1923 bp, Homo sapiens
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttc

SEQ ID NO: 7414 - DNA, 2031 bp, Homo sapiens
gtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccaagtgttgcagcactttcttccttggctgtgaattctcccagtttctgccccttttttttaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgct

SEQ ID NO: 7415 - DNA, 1587 bp, Homo sapiens
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaagggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaa

SEQ ID NO: 7416 - DNA, 1493 bp, Homo sapiens
acatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccaagtgttgcagcactttcttccttggctgtgaattctcccagtttctgcccctttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactagg

SEQ ID NO: 7417 - DNA, 1847 bp, Homo sapiens
gagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctg

SEQ ID NO: 7418 - DNA, 1524 bp, Homo sapiens
gtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaaggcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggaaaagcacaaccaaccatctgaatttactattgaaagcttggaaaacactgcagttgacttgtttggagctgggacagagacgacaagcacaaccctgagatatgctctccttctcctgctgaagcacccagaggtcacagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaagggcacaaccatattaatttccctgacttctgtgctacatgacaacaaagaatttcccaacccagagatgtttgaccctcatcactttctggatgaaggtggcaattttaagaaaagtaaatacttcatgctggttctcaaaatgataaggacagaaaggacaaagaggaagagggtagggaagctattttgggtgagtgttagagttacttgaggattggatttgaaagtgagaaactgtgtccaggggcagctctaacctctagggaaatattcagaggatcagtcaaagggtggaatggacattaaatgctagaattcttatatccacattggtgttccttttttttt

SEQ ID NO: 7419 - DNA, 1433 bp, Homo sapiens
gcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccc

SEQ ID NO: 7420 - DNA, 1684 bp, Homo sapiens
ataagggaagggtcacgcgctcggtgtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaa

SEQ ID NO: 7421 - DNA, 1657 bp, Homo sapiens
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgcggtcagggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 7422 - DNA, 1405 bp, Homo sapiens
caagaggccctgaccctccctctgcagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgcggtcagggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccacgacgcccctttcgccccaacggtctcttggacaaagccgaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttcc

SEQ ID NO: 7423 - DNA, 1348 bp, Homo sapiens
ggcagccatggggctagaagcactggtgcccctggccatgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctag

SEQ ID NO: 7424 - DNA, 1667 bp, Homo sapiens
ctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagattgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagtttaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattatttt

SEQ ID NO: 7425 - DNA, 1912 bp, Homo sapiens
acttccgggttgtttgctcccggagccataaccgcagctcagcgtgcgggcagagccggctgacaggagacaggacacagcacagagccccgcgccctctgaggcgggaggcttcgttcctgcaccagcgtggcttgccctttggacgcggcgagttaacttgagaaagtggaatcgaattccgatgttgaattttccttctggccccattcatgtggcaggtggtgattcaggattgtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaaggaagcgctgctggactacaaggacgagttctcgggcagaggcgacctccccgcgttccatgcgcacagggacaggggaatcatttttaataatggacctacctggaaggacatccggcggttttccctgaccaccctccggaactatgggatggggaaacagggcaatgagagccggatccagagggaggcccacttcctgctggaagcactcaggaagacccaaggccagcctttcgaccccaccttcctcatcggctgcgcgccctgcaacgtcatagccgacatcctcttccgcaagcattttgactacaatgatgagaagtttctaaggctgatgtatttgtttaatgagaacttccacctactcagcactccctggctccagctttacaataattttcccagctttctacactacttgcctggaagccacagaaaagtcataaaaaatgtggctgaagtaaaagagtatgtgtctgaaagggtgaaggagcaccatcaatctctggaccccaactgtccccgggacctcaccgactgcctgctcgtggaaatggagaaggaaaagcacagtgcagagcgcttgtacacaatggacggtatcaccgtgactgtggccgacctgttctttgcggggacagagaccaccagcacaactctgagatatgggctcctgattctcatgaaataccctgagattgaagagaagctccatgaagaaattgacagggtgattgggccaagccgaatccctgccatcaaggataggcaagagatgccctacatggatgctgtggtgcatgagattcagcggttcatcaccctcgtgccctccaacctgccccatgaagcaacccgagacaccattttcagaggatacctcatccccaagggcacagtcgtagtgccaactctggactctgttttgtatgacaaccaagaatttcctgatccagaaaagtttaagccagaacacttcctgaatgaaaatggaaagtttaagtacagtgactatttcaagccattttccacaggaaaacgagtgtgtgctggagaaggcctggctcgcatggagttgtttcttttgttgtgtgccattttgcagcattttaatttgaagcctctcgttgacccaaaggatatcgacctcagccctatacatattgggtttggctgtatcccaccacgttacaaactctgtgtcattccccgctcatgagtgtgtggaggacaccctgaaccccccgctttcaaacaagttttcaaattgtttgaggtcaggatttctcaaactgattcctttctttgcatatgagtatttgaaaataaatattttcccagaatataaataaatcatcacatgattattttaactat

SEQ ID NO: 7426 - DNA, 475 bp, Homo sapiens
aacagtattatggccagaggactcagaccacagctgcatccctgtgaggcacagactctccagggcacgcgggtcccgcctgggatgtgcacactcagttaacttgagaaagtggaatcgaattccgatgttgaattttccttctggccccattcatgtggcaggtggtgattcaggattgtctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagttggaattgaagaatattcccaagtccttcacccggttggcccagcgcttcgggccggtgttcacgctgtacgtgggctcgcagcgcatggtggtgatgcacggctacaaggcggtgaa

SEQ ID NO: 7427 - DNA, 1720 bp, Homo sapiens
aagcacacccagagctgcaggctctagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggagctgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcttcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagtcgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccgcccatgcgggttgctacgtccccttcttggtccacagtctgccctcatccctctggcagtcacgctgtcttccctgcatgctgtgcctgccgcgtgcccttcccccatccctccaatctgtgccccgtct

SEQ ID NO: 7428 - DNA, 1896 bp, Homo sapiens
cgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctgtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaagcacacaggcaatcctacttcaagtttccatgaagaaaacctcatctgcagcaccctggacctcttctttgccggaaccgagacaacttccacaactctgcgatgggctctgctttatatggccctctacccagaaatccaagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaagggtaccatgatcctgaccaatttgacggcgctgcacagggaccccacagagtgggccacccctgacacattcaatccggaccattttctggagaatggacagtttaagaaaagggaagcctttatgcctttctcaataggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctata

SEQ ID NO: 7429 - DNA, 1613 bp, Homo sapiens
cctgggtctcagggctgctgtggagttcgcacctccagctcgggccgatgtggaagctttggagagctgaagagggcgcggcggcgctcggcggcgcgctcttcctgctgctcttcgcgctaggggtccgccagctgctgaagcagaggcggccgatgggcttccccccggggccgccggggctgccatttatcggcaacatctattccctggcagcctcatccgagcttccccatgtctacatgagaaagcagagccaggtgtacggagagatcttcagtttagatcttggaggcatatcaactgtggttctaaatggctatgatgtagtaaaggaatgccttgttcatcaaagcgaaatttttgcagacagaccatgccttcctttattcatgaagatgacaaaaatgggaggcttactcaattccagatatggccgaggatgggttgatcacagacgattagctgtaaacagttttcgatattttggatatggccaaaagtcttttgaatctaaaatcttggaagaaaccaaatttttcaatgatgctattgaaacatacaaaggtagaccttttgactttaaacagttaataacgaatgctgtttcaaacataaccaatctgatcatttttggagaacgattcacttatgaagacaccgattttcagcacatgattgagttatttagtgaaaatgtggaactagctgccagtgcctcagtcttcttgtataatgcctttccatggattggcatcctgccttttggaaaacatcaacagctgtttagaaatgcagctgtagtctatgattttctctccagactcattgaaaaagcttcagtcaacagaaagcctcagctacctcagcattttgttgatgcttatttagatgagatggatcaaggtaaaaatgacccatcatctactttctccaaagaaaacctaattttctcagtgggtgaactcatcattgctggaactgaaactacaaccaatgtgctacggtgggcgattcttttcatggccctttatcctaatattcaaggacaagttcagaaagagattgatttaattatgggccctaatgggaagccttcttgggacgacaaatgcaaaatgccttatactgaggcagttttgcatgaagttttaagattctgtaatatagttccattagggattttccatgcaacctctgaagatgcagttgtacgtggttattccattcctaaaggcacaacagtaattacaaatctttattctgtacactttgatgaaaagtactggagagacccagaagtgttccatcctgagcgatttctggacagcagtggatattttgccaagaaggaagctttggttcctttttccctaggaagaagacattgtcttggagaacacttggctcggatggaaatgttcttgttttttacagcattgcttcagaggtttcatttgcattttccacatgaactagttccagatctgaagcccaggttaggcatgacattgcagccccaaccctacctcatctgtgctgaaagacgctgaaactgcctgggatgttttcgggaacaagaatgtatatttgccttatccctgaacttggtt

SEQ ID NO: 7430 - DNA, 1750 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatag

SEQ ID NO: 7431 - DNA, 2620 bp, Homo sapiens
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagcct

SEQ ID NO: 7432 - DNA, 1479 bp, Homo sapiens
agaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtg

SEQ ID NO: 7433 - DNA, 4944 bp, Homo sapiens
accggacttcggggcaaacttcaggtcccccgcctgctagcccgccaaccccctccgccaggcagccggcgcgcctccaggttccgcccaggcgtcgctgagtggcggcggcggggagaatgcgcgcggcgcagccaatccgggggcgttcctacaccccctgcccgcccccgaccttccagagcagagcaggacactggcgccgcgggtcaggcagctgcgtgcgcgtctcctccaggcagcaaggggaacccgaggccgccggcgcccggaccatgtcgtctccggggccgtcgcagccgccggccgaggacccgccctggcccgcgcgcctcctgcgtgcgcctctggggctgctgcggctggaccccagcgggggcgcgctgctgctatgcggcctcgtagcgctgctgggctggagctggctgcggaggcgccgggcgcggggcatcccgcccgggcccacgccctggcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaagggggttgtgtttgcacattatggtcccgtctggagacaacaaaggaagttctctcattcaactcttcgtcattttgggttgggaaaacttagcttggagcccaagattattgaggagttcaaatatgtgaaagcagaaatgcaaaagcacggagaagaccccttctgccctttctccatcatcagcaatgccgtctctaacatcatttgctccttgtgctttggccagcgctttgattacactaatagtgagttcaagaaaatgcttggttttatgtcacgaggcctagaaatctgtctgaacagtcaagtcctcctggtcaacatatgcccttggctttattaccttccctttggaccatttaaggaattaagacaaattgaaaaggatataaccagtttccttaaaaaaatcatcaaagaccatcaagagtctctggatagagagaaccctcaggacttcatagacatgtaccttctccacatggaagaggagaggaaaaataatagtaacagcagttttgatgaagagtacttattttatatcattggggatctctttattgctgggactgataccacaactaactctttgctctggtgcctgctgtatatgtcgctgaaccccgatgtacaagaaaaggttcatgaagaaattgaaagagtcattggcgccaaccgagctccttccctcacagacaaggcccagatgccctacacagaagccaccatcatggaagtgcagaggctaactgtggtggtgccgcttgccattcctcatatgacctcagagaacacagtgctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatgggccaatcttctcatttcttagtgcctcagacatcccatatgtaaaatgagagtaataaaacttggcttctctctacctctcagcactaatgatggtcaaatgccttacatcttttctgatatctctaaaatgctgttaagttctggagaagaacttcaggagaagaagatctatcagctggcttttaaagacctatgacaacatgaaagtggtgttcagcctggaatgctttgtcagagatgggtgtggatttaggttatactgggggagaacttttctcagcacagattctatgccagcttctttgggcttgttctgtcactatctttttgtttatgattttagtttttactttttgtagatgtgggatgaagtggactctgtcgtgtatattgaggaaaaaagaaattataattttaaaaaatcccttgtaggattattatctaaatttatatgtctaacttctactacaactacaggaacagtgagccttgctacttctttagtagcttcttggcagaattcctttctactgagttatttgcaaagatgcagctctacctttttacttaaggcctgaatggtgagcatggggattttgatactgggactcatcaggaaaggattctgctttcaaactatactgaacattcctgtcctagcgtccctgccaccaggcccaatgcatctgatccttgaatatactctcaaagaattcactctctttttattaagagaactaaattgtttctaaatgtagatggtccctctggaaaagcagttttcagcaggggtggtaaccccttcagagggagtttggaaatgtgtgggtatgattcttggttatcataatgatgggggtgctactggccttctgctgccatgggaccaggatgctaaatgtcaaggtagtcctatacagtgaagaattgtcctgctcaagatgccaggatttcccccagtgagaacatgctctaaggaatgaccacccctttcttttattctcccacagtgctccatgtacagaagtaagcatagcagtcatatgagcaaccacattcctgaacctttcctcatgctggctctacacttaatcctttacttgtatgtttctgtaattcttacataaattctattaagagggtggcatactgtagtggatgaagctgaggcttatagtaggtaaggcacaaagttaaaaagtaacatcactgggtttcaaacctactggtctctgtgactaaagaacactttcagaaccacttcttgattctgccaccacttgatcccataacaggctaccccttggcctcatgctggagttgtgtgtgtctgtcttcatcccaggctgagctccttgaggtgaggatgttgtgctgtttgcctccctcacagtgccttggtcttagtggatgcccagttgtcttgtgaatgacttttaagaagtgtacttaagagaaaaatcctaccttatttgaataattacaagtcatgtttttgttgcttaaaggtgataaatcagtgtatattatttgttaatgtccattaaagccagtttttaaaaaaatcactggacttttgtgtttaccatttaaaacaaccattttaaacaaacttagaacgatgccttagctgtttataggtaacagaatgtaaactcccaccacctggagactaggccatatccagggacctcacactgactttcctaaaggagagaagcagctacgctgttcatactgatagagaagagggcaagaaaagatccagagtggctgttactttgaaaattaaacgaaagatgaaattctgaacttaaaacacttctgtttggccttctataactgatcacccttctttgctctgttttccagataaatggagacaccagatctccctaacctctgacttctgccgttagccatactctgtgtagttagatctcagtctgggaatggcattccagggcaattgtgaacatgaggctagatttttcctttgatttagcacattcctaggcagacttttgcaagctcaaaaaatgaaaataatatctgcttaaccaaaacataatcataggaagaagaaaaattttaaaatgattgatttttgactctacattctttatctaccatactgctcttttcctttttagaaatattactaagcactttccgtatagataaatgaaatacaggctaatctttaggtgtcttaggaatttttgctttttgaaaaagaaaagctaatagcctaactgcagaggaactgagtggatggggtagctgctgtatagatttttagatgagatgatacagtgtggattacactgtaccttgggcgggagagtttgttcttgatatggaattcatatgcttttgaattgcactaataactcagcattaacaagtatattactccttaaattatacatgcattttcaatattcctaaccaaatagtttatagcttattgagaagaagtctgttcttggagagatgttgaaattagatgtttattaaactttaaaatataatgccttaagctgtggcactttaaaaacatctttatatataaattgctaaaaggactgttaatgcttttctcagacacattggcattttacaattttgcacatggtttatttgaaatcaaaaaataactatactttgttttataagtctacctaatatctcatttttgattctcatcgttagcacagttttgttgcttttattaaactattttaa

SEQ ID NO: 7434 - DNA, 1879 bp, Homo sapiens
agagcaggacactggcgccgcgggtcaggcagctgcgtgcgcgtctcctccaggcagcaaggggaacccgaggccgccggcgcccggaccatgtcgtctccggggccgtcgcagccgccggccgaggacccgccctggcccgcgcgcctcctgcgtgcgcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaagggggttgtgtttgcacattatggtcccgtctggagacaacaaaggaagttctctcattcaactcttcgtcattttgggttgggaaaacttagcttggagcccaagattattgaggagttcaaatatgtgaaagcagaaatgcaaaagcacggagaagaccccttctgccctttctccatcatcagcaatgccgtctctaacatcatttgctccttgtgctttggccagcgctttgattacactaatagtgagttcaagaaaatgcttggttttatgtcacgaggcctagaaatctgtctgaacagtcaagtcctcctggtcaacatatgcccttggctttattaccttccctttggaccatttaaggaattaagacaaattgaaaaggatataaccagtttccttaaaaaaatcatcaaagaccatcaagagtctctggatagagagaaccctcaggacttcatagacatgtaccttctccacatggaagaggagaggaaaaataatagtaacagcagttttgatgaagagtacttattttatatcattggggatctctttattgctgggactgataccacaactaactctttgctctggtgcctgctgtatatgtcgctgaaccccgatgtacaagaaaaggttcatgaagaaattgaaagagtcattggcgccaaccgagctccttccctcacagacaaggcccagatgccctacacagaagccaccatcatggaagtgcagaggctaactgtggtggtgccgcttgccattcctcatatgacctcagagaacacagtgctccaagggtataccattcctaaaggcacattgatcttacccaacctgtggtcagtacatagagacccagccatttgggagaaaccggaggatttctaccctaatcgatttctggatgaccaaggacaactaattaaaaaagaaacctttattccttttgggatagggaagcgggtgtgtatgggagaacaactggcaaagatggaattattcctaatgtttgtgagcctaatgcagagtttcgcatttgctttacctgaggattctaagaagcccctcctgactggaagatttggtctaactttagccccacatccatttaatataactatttcaaggagatgaagagcatctccaagaagagatggtaaaaagatatataaatacatatccttctaagcagattcttcctactgcaaaggacagtgaatccagcaactcagtggatccaagctgggctcagaggtcggaaggagggtagagcacactgggaggtttcatcttggaggattcctcagcaggatacttcagccattttagtaatgcaggtctgtgatttgggggatagaaaacaaagtacctatgaaacgggatatctggattttacttgcagtggcttccaccgatg

SEQ ID NO: 7435 - DNA, 1942 bp, Homo sapiens
gtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 7436 - DNA, 2121 bp, Homo sapiens
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcctgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 7437 - DNA, 2182 bp, Homo sapiens
ggtgtcattccagaaaagggccactctgtgggcgggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 7438 - DNA, 1942 bp, Homo sapiens
gtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctctggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcctcccgttccccttaaggaggtggctcccagcactcaaccaacctccccgcagagctcccttcctgaccctctgccgcagaggattgaggcttaatcctgagctggtcctttccagccaataaatcaactccagctccctctgcgaggctggcatgattgttccatttc

SEQ ID NO: 7439 - DNA, 1914 bp, Homo sapiens
gtctcgccatgctgctcctgggcctgctgctgctgctgcccctgctggctggcgcccgcctgctgtggaactggtggaagctccggagcctccacctcccgcctcttgccccgggcttcttgcacctgctgcagcccgacctccccatctatctgcttggcctgactcagaaattcgggcccatctacaggctccaccttgggctgcaagacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 7440 - DNA, 2118 bp, Homo sapiens
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 7441 - DNA, 2114 bp, Homo sapiens
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctc

SEQ ID NO: 7442 - DNA, 2121 bp, Homo sapiens
gggtcggtgggagggtacctgaaggtggggtcaagggaggccccaaaacagtctacacagcaggagggatggctggggctcttgagctataagtggcacctcagggccctgacgggcgtctcgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaggaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctctggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccgggccagagccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcctcccgttccccttaaggaggtggctcccagcactcaaccaacctccccgcagagctcccttcctgaccctctgccgcagaggattgaggcttaatcctgagctggtcctttccagccaataaatcaactccagctccctc

SEQ ID NO: 7443 - DNA, 1939 bp, Homo sapiens
gtctcgccatgctgctcctgggcctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctctgcgaggctggcatgattgttccatttc

SEQ ID NO: 7444 - DNA, 1942 bp, Homo sapiens; identical to SEQ ID NO: 7435

SEQ ID NO: 7445 - DNA, 1939 bp, Homo sapiens; identical to SEQ ID NO: 7443

SEQ ID NO: 7446 - DNA, 2114 bp, Homo sapiens
tgggaaggcacctgagggtggggtcaagggaggccccaaaacagtctacacagcaggagggatggctggggctcttgagctataagtggcacctcagggccctgacgggcgtcttgccatgctgctcctgggcctgctgctgctgctgcccctgctggctggcgcccgcctgctgtggaactggtggaagctccggagcctccacctcctgcctcttgccccgggcttcttgcacctgctgcagcccgacctccccatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 7447 - DNA, 1965 bp, Homo sapiens
gtcaagggaggccccaaaacagtctacacagcaggagggatggctggggctcttgagctataagtggcacctcagggccctgacgggcgtcttgccatgctgctcctgggcctgctgctgctgctgcccctgctggctggcgcccgcctgctgtggaactggtggaagctccggagcctccacctcccgcctcttgccccgggcttcttgcacttgctgcagcccgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagacctgagccacttacctacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttcccctt

SEQ ID NO: 7448 - DNA, 2024 bp, Homo sapiens
tgggaaggcacctgagggtggggtcaagggaggccccaaaacagtctacacagcaggagggatggctggggctcttgagctataagtggcacctcagggccctgacgggcgtcttgccatgctgctcctgggcctgctgctgctgctgcccctgctggctggcgcccgcctgctgtggaactggtggaagctccggagcctccacctcctgcctcttgccccgggcttcttgcacctgctgcagcccgacctccccatctatctgcttggcctgactcagaaattcgggcccatctacaggctccaccttgggctgcaagacaagctggtgtctaagaactacccggacctgtccttgggagactactccctgctctggaaagcccacaagaagctcacccgctcagccctgctgctgggcatccgtgactccatggagccagtggtggagcagctgacccaggagttctgtgagcgcatgagagcccagcccggcacccctgtggccattgaggaggaattctctctcctcacctgcagcatcatctgttacctcaccttcggagacaagatcaaggacgacaacttaatgcctgcctattacaaatgtatccaggaggtgttaaaaacctggagccactggtccatccaaattgtggacgtgattccctttctcaggttcttccccaatccaggtctccggaggctgaagcaggccatagagaagagggatcacatcgtggagatgcagctgaggcagcacaaggagagcctcgtggcaggccagtggagggacatgatggactacatgctccaaggggtggcgcagccgagcatggaagagggctctggacagctcctggaagggcacgtgcacatggctgcagtggacctcctgatcggtggcactgagaccacagcaaacaccctctcctgggccgtggtttttttgcttcaccaccctgagattcagcagcgactgcaggaggagctagaccacgaactgggccctggtgcctccagctcccgggtcccctacaaggaccgtgcacggctgcccttgctcaatgccaccatcgccgaggtgctgcgcctgcggcccgttgtgcccttagccttgccccaccgcaccacacggcccagcagcatctccggctacgacatccctgagggcacagtcatcattccgaacctccaaggcgcccacctggatgagacggtctgggagaggccacatgagttctggcctgatcgcttcctggagccaggcaagaactccagagctctggccttcggctgcggtgcccgcgtgtgcctgggcgagccgctggcgcgcctggagctcttcgtggtgctgacccgactgctgcaggccttcacgctgctgccctccggggacgccctgccctccctgcagcccctgccccactgcagtgtcatcctcaagatgcagcctttccaagtgcggctgcagccccgggggatgggggcccacagcccaggccagaaccagtgatggggcaggaccgatgccagccgggtacctcagtttctcctttattgctcccgtacgaacccctcccctcccccctgtaaacacagtgctgcgagatcgctggcagagaaggcttcctccagcggctgggtggtgaaggaccctggctcttctctcggggcgacccctcagtgctcggcagtcatactggggtgcgagagaggtgggcagcagctcagcctccccccgctggggagcgaaagtttcttggtctcagcttcatttccgtgaagggcaccgagaactcgaagcccttccagtggtaccagctcactccctgggaaaggggttgtcaagagagagtcaaagccggatgtcccatctgctcttcccgttccccttaaggaggtagctcccagcactcaaccaacctccccgcagagctcccttcctgaccctccgctgcagaggattgaggcttaattctgagctggccctttccagccaataaatcaactccagctccctc

SEQ ID NO: 7449 - DNA, 3262 bp, Homo sapiens
ggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgttgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatt

SEQ ID NO: 7450 - DNA, 2227 bp, Homo sapiens
ctagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgttgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtt

SEQ ID NO: 7451 - DNA, 2125 bp, Homo sapiens
agcgctggcggcggcggcaggtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctacagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaatagtgcc

SEQ ID NO: 7452 - DNA, 2245 bp, Homo sapiens
cggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctacagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaat

SEQ ID NO: 7453 - DNA, 2125 bp, Homo sapiens; identical to SEQ ID NO: 7451

SEQ ID NO: 7454 - DNA, 1569 bp, Homo sapiens
atgttcccttgggggctgagctgcctgtcagtgctgggggcggcgggcactgctctcctgtgcgcgggcctgctgctcagcctggcccagcacctctggaccctccgctggatgctgagccgggaccgggcctccaccctgcctctgcccaagggctccatggggtggcccttcttcggcgaaacgctgcactggttagttcagggctcgcgcttccacagttctcgccgagagcgctatgggacagtgttcaagacgcacctgctgggcaggccagtgatccgcgtgagcggcgcggagaacgtgcgcaccatcctgctgggcgagcaccgcctggtgcgcagccagtggccgcagagtgcgcacatcctgctgggctcgcacacactgctaggtgcggtcggcgagccgcaccggcggcggcgcaaggtcctggcgcgcgtgttcagccgcgccgcgctggagcgctacgtgccgcgcctgcagggggcgctgcggcatgaggtgcgctcctggtgcgcggcgggcgggccggtctcagtctacgacgcctccaaagcgctcaccttccgcatggccgcgcgcatcctgctggggttgcggctggacgaggcgcagtgcgccacgctggcccggaccttcgagcagctcgtggagaacctcttctcactgcctctggacgttcccttcagtggcctacgcaagggcatccgggcaagggaccagctgcatcggcacctggagggggccatttctgagaagcttcacgaggacaaggctgcagagccgggtgatgccctcgacctaatcattcacagtgcaagggagctgggccatgagccctccatgcaggagctgaaggagtcggctgtggagctcctcttcgccgccttcttcaccacggccagtgccagcacctcgctcgtcctgctgctactgcagcatccggcggccatcgccaagattcgggaggagctggtggcgcaggggctggggcgcgcgtgcggctgcgcgcccggggccgctgggggcagcgaggggcccccgcccgactgcggctgcgagcccgacctcagcctcgcggcgctgggccgtctgcgctacgtcgactgcgtggtcaaggaggtgctgcgcctcctgccgccagtgtccgggggctaccgcaccgccctgcgcaccttcgagctcgacggctaccagatccccaagggctggagcgtgatgtatagcatccgggacacgcacgagacggctgcggtgtaccgcagccctcccgaaggcttcgatccagagcgcttcggcgcagcgcgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctga

SEQ ID NO: 7455 - DNA, 2286 bp, Homo sapiens
gccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggcaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattgga

SEQ ID NO: 7456 - DNA, 2540 bp, Homo sapiens
ttgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccatt

SEQ ID NO: 7457 - DNA, 2153 bp, Homo sapiens
acaggtggccctgctactggctgcagctccagccctgcctccttctctagcatataaacaatccaacagcctcactgaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagta

SEQ ID NO: 7458 - DNA, 2318 bp, Homo sapiens
cactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctcgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtc

SEQ ID NO: 7459 - DNA, 1361 bp, Homo sapiens
acggatctcattccaaacttggctgtggaaacctggcttctccttactaaactagaatttcacacagcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctga

SEQ ID NO: 7460 - DNA, 1515 bp, Homo sapiens
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagtaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctga

SEQ ID NO: 7461 - DNA, 1349 bp, Homo sapiens
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctga

SEQ ID NO: 7462 - DNA, 1279 bp, Homo sapiens
gcacagcccagcaaagagcagcacacagctgaaagaaaaactcagaagacagagctgaaaaagaaaactggtgatggatctcattccaaactttgccatggaaacatgggttcttgtggctaccagcctggtactcctctatatggtctttggaattttgacagagaatgtaatgaaaaatacggagaaatgtggggcctttaggtccaatgggatttctgaaaagtgccttaagttttgctgaagatgaagaatggaagagaatacgaacattgctatctccagctttcaccagtgtaaaattcaaggaagtaagaaaataaggtgatttataattagaaacttaaaggatgaatctggagacaggtaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatacagagtctcgctgtgttgcctaggccggagtgcatggtgcgatctgggctcactgaaacctccacctcctgggttcgagtgattctcctgcctcagcctcctgaggagctgggattacagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaagatcccactgaaattagacaatctaccaattcttcaaccagaaaaacctattgttctaaaagtgcacttaagagatgggattacaagtggaccctga

SEQ ID NO: 7463 - DNA, 1709 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtgggggctgtatgaggggcaacagcccatgctggtcatcatggatcccgacatgatcaaaacagtgttagtgaaagaatgttactctgtcttcacaaaccagatgcctttaggtccaatgggatttctgaaaagtgccttaagttttgctgaagatgaagaatggaagagaatacgaacattgctatctccagctttcaccagtgtaaaattcaaggaaatggtccccatcatttcccaatgtggagatatgttggtgagaagcctgaggcaggaagcagagaacagcaagtccatcaacttgaaagatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctgactttccctaaggacttccactttgttcaagaaagctgtatcccagaacactagacacttcaaattgttttgtgaataaaactcagaaatgaaga

SEQ ID NO: 7464 - DNA, 1192 bp, Homo sapiens
atggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatttctttggggcctacaccatggatgtaatcactggcacattatttggagtgaacttggattctctcaacaatccacaagatccctttctgaaaaatatgaagaagcttttaaaattggattttttggatccctttttactcttaatatcactctttccatttcttaccccagtttttgaagccctaaatatcggtttgtttccaaaagatgttacccattttttaaaaaattccattgaaaggatgaaagaaagtcgcctcaaagataaacaaaagcatcgagtagatttctttcaacagatgatcgactcccagaattccaaagaaacaaagtcccataaagctctgtctgatctggagcttgtggcccagtcaattatcatcatttttgctgcctatgacacaactagcaccactctccccttcattatgtatgaactggccactcaccctgatgtccagcagaaactgcaggaggagattgacgcagttttacccaataaggcacctgtcacctacgatgccctggtacagatggagtaccttgacatggtggtgaatgaaacgctcagattattcccagttgttagtagagttacgagagtctgcaagaaagatattgaaatcaatggagtgttcattcccaaagggttagcagtgatggttccaatctatgctcttcaccatgacccaaagtactggacagagcctgagaagttctgccctgaaaggttcagtaagaagaacaaggacagcatagatctttacagatacataccttttggagctggaccccgaaactgcattggcatgaggtttgctctcacaaacataaaacttgctgtcattagagcactgcagaacttctccttcaaaccttgtaaagagactcagatcccactgaaattagacaatctaccaattcttcaaccagaaaaacctattgttctaaaagtgcacttaagagatgggattacaagtggaccctga

SEQ ID NO: 7465 - DNA, 328 bp, Homo sapiens
acctctgggcagagaaacaaagctctatatgcacagcccagcaaagagcagcacacagctgaaagaaaaactcagaagacagagctgaaaaagaaaactggtgatggatctcattccaaactttgccatggaaacatgggttcttgtggctaccagcctggtactcctctatatttatgggacccattcacataaactttttaagaagctgggaattcctgggccaacccctctgccttttctgggaactattttgttctaccttaggggtctttggaattttgacagagaatgtaatgaaaaatacggagaaatgtggggaccctaa

SEQ ID NO: 7466 - DNA, 1720 bp, Homo sapiens
gctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgta

SEQ ID NO: 7467 - DNA, 3320 bp, Homo sapiens
ctgctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtgtacatattacctccctctcttgaccattccagttcctgagtaactcaccagccctctgatctataaagtcacaatccctgtgacctgatttctgtttcactttgtagatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggtatctcttccctgtttggaccacattacccttcatcatatgaagccttgggtggctcctgtgtgagactcttgctgtgtgtcacaccctaatgaactagaacctaaggttgctgtgtgtcgtacaactagggctccgttgtccccacacagaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaaggtaaaatctgatggtggttaaatgacgatgtttaggttttgataaatttagattttatacacatgatagagcatgtatctgtatttttaaaaataaagacagagaacttatgtttagaacaagagaagccatttggtagaaataaagaaggagattggggaaggagatgagaatgagtcagagagatagcatttaaaacttgaaatcaggcacaacaattagtatgtcatgatataaacagtattgagataaaattttaccacttctcttccctttaataaattgtcaaaggataaagtttcctgtttgaaaatatattttactggtattgtgctttcctcatatcacagattggtaaagaatcattttaagtccaagactcttattttacatattctgcaattaaaggtcctatgaggctacctgccgactgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatgagaaacagggagggcaaaggcgaaaaagcaattggacatgatagctagatttgtttcaggaaaacatcctgctttccaaggatttagatgaatgtttttgttcactggtgactcaggtaacacgtcttcaagaagccatagggaggttgagggagggaagtcaagaagggaggttgaggactgcacttttgatttacttctgacttcacgagtcactttctgccaaagaaatctctccttttgcttctagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatct

SEQ ID NO: 7468 - DNA, 1971 bp, Homo sapiens
gtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatct

SEQ ID NO: 7469 - DNA, 1599 bp, Homo sapiens
atggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggagagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagacctttgtagatatggagcccattcacatggactttttaagaagcttggcattccagggcccacacctctgctttttttgggaactactttgtcctaccatcagg

SEQ ID NO: 7470 - DNA, 1971 bp, Homo sapiens
gtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggagagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctcttcaagaaagctgtgccccagaacaccagagacctcaaattactttacaaatagaaccctgaaatgaagacgggcttcatccaatgtgctgcataaataatcggggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttac

SEQ ID NO: 7471 - DNA, 2176 bp, Homo sapiens
gaagtggaggtgggagggagcgacaatggaaaaatcacctgaaaactgggacagaggaaggaagctacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgtagacccccgtgcatcaagggctggattccttggattggagttggatttgagtttgggaaagcccctctagaatttatagagaaagcaagaatcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatgacatctgttgggcctcacaaggaccagggccttctggaggagtggcactaccccacctggcagcacctagacctgagctctacaaaaacacactgcttcactttgttttaggacttagttcaagaacacattcaaatggtgcatgtgtttggtatcttcaacagtagaccaagaatctaacatcactctcagtaatatagagaccggaatacatggtttataggaaatgatcaaatgatccaaaaaaactccacattttttaagaagttggaatttgatttcatgcataactgtattaaaacattaaatagaaataatgtcatttgaatgaaaatcttatcacattaaattcactgtgaaggcagcatacttaaatttttattttgaaaagtctaaaaggcttagatttttaaaatttaataattatttctacaaattttctatttttcttgaggtgattctcaactagcaattggaactcctaggctctattaacataattctttattgtaaacgtatctaatgctaaaagtaataaaatggtagttttctgagacctgtga

SEQ ID NO: 7472 - DNA, 2530 bp, Homo sapiens
ggggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccaccttcccttcttcccacctgcctgctgtcccccagtctgcctgcccttctctctctcacctttctccaggctccctacctgcttgtctacctgtctcctacccacctgtatctcttgttgggagaaaagctgagtgttgggagaagctgaggccgagcttgcatgtctgacataatgtaaaagagtcttggatcatgtccaggatccagggtctaaaaccccttgtggcctttggaacaccaagctctgtgctgaagggtggaaggctaccctgacgcaccataatctaagcccggggcataaaacccctcgtggcttggatagaatccagggctcgtggctctggaatgtgtctgaacttgctgcctcctcgctccttgctctcccaggatcaattgtatcttgagttaaaagaacctgctctccattatctcaagtagcagagcagatgctaaaccgtcacagctgtaaatcatgtgcttaatgcaacatgccctttcgacccccacattctcaccacctgtttctttgtttgatcaccaataaataatctgcacttccagagctcggggccttcacagcctccatccttagctttggcgccctggacccactttctctctcaaactgtcttttctcactgctttgactctgccggactttgtcacccccacgacctggtgttgggtctgaacaccccaacatccctgaatctccacccacctcccaaactcctgcctgccctccagactgtctgcccatacacctgtctccttcttcctgcctgcttgtctgttcctatattagtttcctattactgctgtaataaactatcacaatctcagtgattttaaa

SEQ ID NO: 7473 - DNA, 1760 bp, Homo sapiens
agagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacaggagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggaactgcatcgggaaacaatttgccatgaacgagctgaaggtggccacggccctgaccctgctccgctttgagctgctgcctgatcccaccaggatccccatccccattgcacgacttgtgttgaaatccaaaaatggaatccacctgcgtctcaggaggctccctaacccttgtgaagacaaggaccagctttgagggcctccacctgccgtcctgtcttcctgacccccgcttctgtccccttcctgtctgcccatatcctgttttctgtctgcccatacacctgtctccttcttcctgcctgcttgtctgttcctatattagtttcctattactgctgtaataaactatcacaatctcagtgatttt

SEQ ID NO: 7474 - DNA, 1725 bp, Homo sapiens
gggcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacaggaattctcagtcctacatacaggccattagtgacctgaacaacctggttttttcccgtgtgaggaatgcctttcaccagaatgacaccatctacagcctgacctctgctggccgctggacacaccgcgcctgccagctggcccatcagcacacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctggaaccacctggaccagatgccctacaccaccatgtgcattaaggaggcactgaggctctacccaccggtgccaggcattggcagagagctcagcactcccgtcaccttccctgatgggcgctccttgcccaaaggtatcatggtcctcctctccatttatggccttcaccacaacccaaaagtgtggcccaacccagaggtgtttgaccctttccgttttgcaccgggttctgctcaacacagccacgctttcctgcccttctcaggaggatcaaggtgagacgtcctgtgtggtaattcgaatagaggaatgagggaagtctctggtcaaccctctgatctttgtgagcctgatgttcatatgtggcatcttcaggtgtgctcttaaatgttggtatttgtgggaaagtcaggcacctggtgtgggcgtctctgtgtacaaaaggaaggtggcattcagagcaccccatggagactttgctccctctgcttcttcaaatgggcagcctgaattcactgtcagtgcatgttccaaacttcagtatattcatgtattttcctcactttaaggatatgaattctcaaaattagatattctccagtaaa

SEQ ID NO: 7475 - DNA, 1036 bp, Homo sapiens
ctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcattggctatggggaggcaaagttcgtgtccagctctatgaccctgactatatgaaggtgattctggggagatcagacccgaaatcccatggttcctacagattcctggctccatggattgggtacggcttgctcctgttgaatgggcagacatggttccagcatcgacggatgctgaccccagccttccactatgacatcctgaagccctatgtggggctcatggcagactctgtacgagtgatgctggacaaatgggaagagctccttggccaggattcccctctggaggtctttcagcacgtctccttgatgaccctggacaccatcatgaagtgtgccttcagccatcagggcagcatccaggtggacagaccaagtgatccaactgaggaaggctcaactacagaaggagggggagctggagaagatcaagaggaagaggcatttggattttctggatatcctcctcttggccaaaatggagaatgggagcatcttgtcagacaaggacctccgtgctgaggtggacacgttcatgtttgagggccacgacaccacagccagtgggatctcctggatcctctatgctctggccacacaccccaagcatcaggagaggtgccgggaggagatccacagcctcctgggtgatggagcctccatcacctgatgccctacaccaccatgtgcattaaggaggcactgaggctctacccaccggtgccaggcattggcagagagctcagcactcccgtcaccttccctgatgggcgctccttg

SEQ ID NO: 7476 - DNA, 2973 bp, Homo sapiens
gaggcaaagacctcctagcagagggggagaggagggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggat

SEQ ID NO: 7477 - DNA, 2872 bp, Homo sapiens
ggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttgg

SEQ ID NO: 7478 - DNA, 3395 bp, Homo sapiens
gaggcaaagacctcctagcagagggggagaggagggtatgtgggacaagctgcttctgataggagccaggctggcagtggcagggctggagggtcctggcctgggatggggaggggactgcccaaggttggggtgggtcaaggctgctggcctgggagactggtgatttcctggtaactggacccctggcaacctcccagtgattcaggctgggcctttttggattctaatcagcctctctctctctttccctttctgtgtaactggaggccacttggctgctggttttcattgggcatttctggactttagatctcagctcttgtttacccatctcagagccttccctgatctgcctccagcactgcccatccttgcccctttccactgtccttggagcttcctgggcccttccctgggcctcaggatcccaccctccatcccgtctgccctgcaggatgccgcagctgagcctgtcctggctgggcctcgggcccgtggcagcatccccgtggctgcttctgctgctggttggaggctcctggctcctggcccgcgtcctggcctggacctacaccttctatgacaactgccgccgcctccagtgttttcctcaacccccgaaacagaactggttttggggacaccagggcctggtcactcccacggaagagggcatgaagacattgacccagctggtgaccacatatccccagggctttaagttgtggctgggtcctaccttccccctcctcattttatgccaccctgacattatccggcctatcaccagtgcctcagctgctgtcgcacccaaggatatgattttctatggcttcctgaagccctggctgggggatgggctcctgctgagtggtggtgacaagtggagccgccaccgtcggatgttgacgcctgccttccatttcaacatcttgaagccttatatgaagattttcaacaagagtgtgaacatcatgcacgacaagtggcagcgcctggcctcagagggcagcgccagactggacatgtttgaacacatcagcctcatgaccttggacagtctgcagaaatgtgtcttcagctttgaaagcaattgtcaggagaagcccagtgaatatattgccgccatcttggagctcagtgcctttgtagaaaagagaaaccagcagattctcttgcacacggacttcctgtattatctcactcctgatgggcagcgcttccgcagggcctgccacctggtgcacgacttcacagatgccgtcatccaggagcggcgctgcaccctccccactcagggtattgatgatttcctcaagaacaaggcaaagtccaagactttagacttcattgatgtgcttctgctgagcaaggatgaagatgggaaggaattgtctgatgaggacataagagcagaagctgacaccttcatgtttgagggccatgacactacagccagtggtctctcctgggtcctataccaccttgcaaagcacccagaataccaggaacagtgccggcaagaagtgcaagagcttctgaaggaccgtgaacctatagagattgaatgggacgacctggcccagctgcccttcctgaccatgtgcattaaggagagcctgcggttgcatcccccagtcccggtcatctcccgatgttgcacgcaggactttgtgctcccagacggccgcgtcatccccaaaggcattgtctgcctcatcaatattatcgggatccattacaacccaactgtgtggccagaccctgaggtctacgaccccttccgtttcgaccaagagaacatcaaggagaggtcacctctggcttttattcccttctcggcagggcccagaaactgcatcgggcaggcgttcgccatggctgagatgaaggtggtcctggcgctcaccctgctgcacttccgcatcctgccgacccacactgaaccccgcaggaaacccgagctgatattgcgcgcagagggtggactttggctgcgggtggagcccctgggtgcgaactcacagtgactgtcctacccacccacccacctctgtagagtcccagaaacaaaactatgctgacacctctgcttgagcctcgttgacagccagcatggggctcctggggactggtgggatctaagaaagggaggtgagtgggtggaggcagggtgacgtctctgaacccaaaaccctgacggcctctctggctgagcacagggcatctaggcccttagtgggttctcccagagcccaagtaaaaactttatcctgtgggcagtagggagccctgggaggtgtttgagcaggagagggaacaggattaagaatgggtttaaggagcaagactgagactctgattcagcgagaaacaaccataggggcagatcccttcatctgtcctgggaatgtcctcccaagactggagtcctcagctcagaacaaagggaaaggggtgcagcttccaccctggcaggctctcagaaatttttagttcctttttccaccaacttcccacccctgtttctccccctcccagtgcgttctctctgtgactctcttcccttactttcagaggcataggatctggagccagactgcttgggctcaagtcctggctctgctgcgtgacttgagcaagttaattcctctctctgtgcctcggttccctcaaccatataatggagacaacagcattacctatatcagggttttcctgaggtctcaatataagggactcagagctgtgcctggcacacaatgaatgctaaatatatggagccattattatttcctgtctcagaaagtctggctgttaaagaatgttgtctttcaagatcgttatttctaccacgactttaaaggctgtgttttggaactcaaaggcaaaaattctaatatctgtgctccttgaacaacctcttctcctagagggctgtgcatataagatatgtatatatatatatatattatatatatatatatatacacacacacacacacacacacacacatatatacatatacacacacacacacacacacacacacacacacacacatatatatatatatatatttttttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggat

SEQ ID NO: 7479 - DNA, 1688 bp, Homo sapiens
agctcttccctgggcctcaggtcctcaccctgcatcccctctgccctgcaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacgatatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagttgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacct

SEQ ID NO: 7480 - DNA, 2044 bp, Homo sapiens
gctgccaactgtcatgataagtatatgcttttatctgaacacccttgtcttggaagggcagggtggaggtaaacttggggttcagagtcccctctaaccaccctccaacttcccctgcaaactcccaagaaggtactgagacctgagaattcagtgctcgtgctggggcaccctgagctgcacccagtgggcccaaccccaggttttggctggctgcccaggcacggaagacacacccaggctgtggggattggctgcctcagcccagcccagcccagccccgcctcctacggccttccctagatcaggggccagggccaaagacctcccagcagaagaggagaagaggttgtgtgggacaagctgctcccgacagaaggatgtcgctgctgagcctgccctggctgggcctcagaccggtggcaacgtccccatggctactcctgctgctggttgtgggctcctggctactcgcccgcatcctggcttggacctatgccttctataacaactgccgccggctccagtgtttcccacagcccccaaaacggaactggttttggggtcacctgggcctgatcactcctacagaggagggcttgaagaactcgacccagatgtcggccacctattcccagggctttacgatatggctgggtcccatcatccccttcatcgttttatgccaccctgacaccatccggtctatcaccaatgcctcagctgccattgcacccaaggataatctcttcatcaggttcctgaagccctggctgggagaagggatactgctgagtggcggtgacaagtggagccgccaccgtcggatgctgacgcccgccttccatttcaacatcctgaagtcctatataacgatcttcaacaagagtgcaaacatcatgcttgacaagtggcagcacctggcctcagagggcagcagttgtctggacatgtttgagcacatcagcctcatgaccttggacagtctacagaaatgcatcttcagctttgacagccattgtcaggagaggcccagtgaatatattgccaccatcttggagctcagtgcccttgtagagaaaagaagccagcatatcctccagcacatggactttctgtattacctctcccatgacgggcggcgcttccacagggcctgccgcctggtgcatgacttcacagacgctgtcatccgggagcggcgtcgcaccctccccactcagggtattgatgattttttcaaagacaaagccaagtccaagactttggatttcattgatgtgcttctgctgagcaaggatgaagatgggaaggcattgtcagatgaggatataagagcagaggctgacaccttcatgtttggaggccatgacaccacggccagtggcctctcctgggtcctgtacaaccttgcgaggcacccagaataccaggagcgctgccgacaggaggtgcaagagcttctgaaggaccgcgatcctaaagagattgaatgggacgacctggcccagctgcccttcctgaccatgtgcgtgaaggagagcctgaggttacatcccccagctcccttcatctcccgatgctgcacccaggacattgttctcccagatggccgagtcatccccaaaggcattacctgcctcatcgatattataggggtccatcacaacccaactgtgtggccggatcctgaggtctacgaccccttccgctttgacccagagaacagcaaggggaggtcacctctggcttttattcctttctccgcagggcccaggaactgcatcgggcaggcgttcgccatggcggagatgaaagtggtcctggcgttgatgctgctgcacttccggttcctgccagaccacactgagccccgcaggaagctggaattgatcatgcgcgccgagggcgggctttggctgcgggtggagcccctgaatgtaagcttgcagtgactttctgacccatccacctgtttttttgcagattgtcatgaataaaacggtgctgtcacctctgcctgggcctcactgacagcctgcag

SEQ ID NO: 7481 - DNA, 2445 bp, Homo sapiens
caggatgctgcccatcacagaccgcctgctgcacctcctggggctggagaagacggcgttccgcatatacgcggtgtccacccttctcctcttcctgctcttcttcctgttccgcctgctgctgcggttcctgaggctctgcaggagcttctacatcacctgccgccggctgcgctgcttcccccagcctccccggcgcaactggctgctgggccacctgggcatgtaccttccaaatgaggcgggccttcaagatgagaagaaggtactggacaacatgcaccatgtactcttggtatggatgggacctgtcctgccgctgttggttctggtgcaccctgattacatcaaaccccttttgggagcctcagctgccatcgcccccaaggatgacctcttctatggcttcctaaaaccttggctaggggatgggctgctgctcagcaaaggtgacaagtggagccggcaccgtcgcctgctgacacccgccttccactttgacatcctgaagccttacatgaagatcttcaaccagagcgctgacattatgcatgctaaatggcggcatctggcagagggctcagcggtctcccttgatatgtttgagcatatcagcctcatgaccctggacagtcttcagaaatgtgtcttcagctacaacagcaactgccaagagaagatgagtgattatatctccgctatcattgaactgagcgctctgtctgtccggcgccagtatcgcttgcaccactacctcgacttcatttactaccgctcggcggatgggcggaggttccggcaggcctgtgacatggtgcaccacttcaccactgaagtcatccaggaacggcggcgggcactgcgtcagcagggggccgaggcctggcttaaggccaagcaggggaagaccttggactttattgatgtgctgctcctggccagggatgaagatggaaaggaactgtcagacgaggatatccgagccgaagcagacaccttcatgtttgagggtcacgacacaacatccagtgggatctcttggatgctgttcaatttggcaaagtatccggaataccaggagaaatgccgagaagagattcaggaagtcatgaaaggccgggagctggaggagctggagtgggacgatctgactcagctgccctttacaactatgtgcattaaggagagcctgcgccagtacccacctgtcactcttgtctctcgccaatgcacggaggacatcaagctcccagatgggcgcatcatccccaaaggaatcatctgcttggtcagcatctatggaacccaccacaaccccacagtgtggcctgactccaaggtgtacaacccctaccgctttgacccggacaacccacagcagcgctctccactggcctatgtgcccttctctgcaggacccaggaattgcatcggacagagcttcgccatggccgagttgcgcgtggttgtggcactaacactgctacgtttccgcctgagcgtggaccgaacgcgcaaggtgcggcggaagccggagctcatactgcgcacggagaacgggctctggctcaaggtggagccgctgcctccgcgggcctgagcgtgggcgcgcccctgcggctcccgagggtccaggccccgcccccaaaggaccaggactcgccccaaagatcccgagggcataggccacccccctcgaagttcaggttcagctcctggatgaccaggcaccgctgttgagcagcctggtggtactggccacgcccctcaaggcaaggctcctccccttagggggcctgatcccgccccttgaggcttaggtcccgccccctgacttctcgcacctgtcctgtttgagggaccagggtcgaccctgcccccttgggctcaggccccgcccccaggatcctacggattgaggtcctcaggccacgcccctgcagatccaggtctccaggccttgcccactgagccttcagaggacctaagacccacctatgactcagggcccaccacaccccacccccccccaactggctgaacccctggcaggcttccaaactgaggaaagctggagcctgacgtcagagcttttaactcggacatcaccctcctgaggccctcagctcatacgggcagactgctcaggcgtgaggctggatcgtagggttcgaggctgcttgcttttgttgttgttttgtaaactcagacccttgtaagccccttccttcctcccttgcccaaagatcctttgctgagtgttctgtttttgcagaataaaagcaaaggatgcagacttaccccaccctccacccctagctcagccagatccttacacgtggagcccccagcatgggaatgaggggctctgcaactgagcgaagctgcgggctaggaggctggaaagccatttatcctaggacataaactcagattttgggggtc

SEQ ID NO: 7482 - DNA, 5052 bp, Homo sapiens
agaagaaggggagaggaggttgtgtgggacaaggtgctcctgacagaaggatgccacagctgagcctgtcctcgctgggcctttggccaatggcagcatccccgtggctgctcctgctgctggttggggcctcctggctcctggcccgcatcctggcctggacctataccttctatgacaactgctgccgcctccggtgtttcccgcaacccccgaaacggaattggttcttgggtcacctgggcctgattcacagctcggaggaaggtctcctatacacacaaagcctggcatgcaccttcggtgatatgtgctgctggtgggtggggccctggcacgcaatcgtccgcatcttccaccccacctacatcaagcctgtgctctttgctccagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatcagttacaaattgagttattcttcatcaaatgacttttggagtagagattttatttttatagcaatagatgcacagatattcctgtaagatacaggtgtggttagacacttttctagaacaggcatgccctgcaaactccacagacactgactgtttttgtcctattaagaagtagaccactgagaagggagaaggtgacattttagctttcccaggtaaaagtggttttcatcctcacaccaattttatggactggacgttaactctcttgctcaaggtcactctgagtggaagagtggggataaatctggttcgtttggcatcagaggccatgacttttcctaccacagaagtaattttcaaagtaagtctctgccctaggcacatcagatcacctggggaccactccagagtgagtagacaagactttgacaggggtgcctaatttttttttttttttgagatggagtctcgctctgttgcccaggctggagtgcagtggcatgatctcagttcactgcaacctccgcctcctgcgttcaagtgattgtcctgtctcagcctcccaagtagctgggattacaggcacccaccaccacatccagctaattgttgtatttttaatagaggcggggtttcgccatgttgcactggctggtgttgaactcctaacctcaggtgatccacccgcctcggcctcccaaagtgctgggattacaggcccggtccagtttgatagtttgttatcatgttatacgtacacttagaataatgatccagccatctcattctaacagcaatgagaacttaggctcccctctctactaaaatacaaaagttagctggtcatggtggtgcgggcctgtaatcccagctactcgggaggctgatgcgggagaatcacttgaaacccacaggcggaggttgcagtgagctgaggtggtgccactacgctccagcctgggggagggggacatagcgagactcggtctcaaaaacaaaacaaaacaaaacaaaacaaaacaaaaacaaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacattttttccccaataatttttggctattctgcttcctttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaag

SEQ ID NO: 7483 - DNA, 1881 bp, Homo sapiens
aaaaaacctcccagaagaaggggagaggaggttgtgtgggacaaggtgctcctggctcctggcccgcatcctggcctggacctataccttctatgacaactgctgccgcctccggtgtttcccgcaacccccgaaacggaattggttcttgggtcacctgggcctggtcacccccacggagcagggcatgagggtcctgactcagctggtggccacctacccccagggctttaaggtctggatgggccccatcttccccgtcatccgtttttgccaccccaacatcatccggtctgtcatcaacgcctcagctgccattgtaccaaaggacaaggtcttctacagcttcctgaagccctggctgggggatgggctcctgctgagtgctggtgaaaagtggagccgccaccgtcggatgctgacgcctgccttccatttcaacatcctgaagccctatatgaagattttcaatgagagtgtgaacatcatgcatgccaagtggcagctcctggcctcagagggtagtgcccgtctggacatgtttgagcacatcagcctcatgaccttggacagtctgcagaaatgtgtcttcagctttgacagccattgccaggagaagcccagtgaatatattgccgccatcttggagctcagtgcccttgtgacaaaaagacaccagcagatcctcctgtacatagacttcctgtattatctcacccctgatgggcagcgtttccgcagggcctgccgcctggtgcacgacttcacagatgccgtcatccaggagcggcgccgcaccctccctagccagggtgttgatgacttcctccaagccaaggccaaatccaagactttggacttcattgatgtactcctgctgagcaaggatgaagatgggaagaagttgtccgatgaggacataagagcagaagctgacacctttatgtttgagggccatgacaccacagccagtggtctctcctgggtcctgtaccaccttgcaaagcacccggaataccaggagcgctgtcggcaggaggtgcaagagcttctgaaggaccgtgagcctaaagagattgaatgggacgacctggcccagctgcccttcctgaccatgtgcattaaggagagcctgaggctgcatcccccagtccctgccgtctctcgctgctgcacccaagacattgtgctcccagacggccgggtcatccccaaaggcattatctgcctcatcagtgtttttggaacccatcacaacccagccgtgtggccggaccctgaggtctatgacccctttcgctttgacccaaagaacatcaaggagaggtcacctctggcttttattcccttctcagcagggcccaggaactgcatcgggcaggcgttcgcgatggcggagatgaaggtggtcctggggctcacgctgctgcgcttccgcgtcctgcctgaccacaccgagccccgcaggaagccggagctggtcctgcgcgcagagggcggactttggctgcgggtggagcccctgagctgagttctgcagagacccactctgaccccactaaaatgacccctgattcatcaaaagtgaggcctagaattaccctaagaccctgttccacagtcctgtattccatcctagatatctactcaaaataattgagacaagtgttcaaacagaaagacgcttgtgcgtgaatgttcatggcagccctattcacagtagccaaacgatgaaaacaaccccaagctatatattaccagatgaaaggataaacaaaatatggtccatccatacaatggagtattacacagccataaaaaggaatgaagcagtgatccccactacactgtggatgaaccttgaatgcatgatactgaatg

SEQ ID NO: 7484 - DNA, 1292 bp, Homo sapiens
agcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgacccagaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatgg

SEQ ID NO: 7485 - DNA, 1904 bp, Homo sapiens
agcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggggatgggctcttgttaagtgttggtgacaagtggagacaccaccgtcgcttgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaagggaatgtctgtaacatcaacatcttcgcaatccatcacaacccctcagtctggccagaccctgaggtctatgaccccttccgcttcgacccagaaaacgcccagaagaggtcacctatggcttttattcctttctcggcggggcccaggaactgcatcgggcagaagttcgcgatggcagagatgaaggtggtcctggcgctcacgctgctgcgcttccgcatcctgcccgaccacagggagccacgcaggacgccggagattgttttgcgtgcggaggacggactttggctgcgagtagaacccctgggctgaggcctgcagtgacccacccacctacctttgcatcacctacctttgcaccaactaccttttcagatttccggtaataaatctgtgttggcccctgtgcctcagtcccgcggatggccagtagggggcgctggaggactgcggggatctagggcctggctgggaagaggcggggagatgtctctgtgcccaagatactcactgcctctctgggtgagcacaggagccccgtgctgagggtgggatctcccagagtctaagtaaagactttttcccccccaaa

SEQ ID NO: 7486 - DNA, 1519 bp, Homo sapiens
agcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctggacctatgccttctatcacaacggccgccgcctccggtgtttcccgcagccccggaaacagaactggttcttgggtcacctgggcctggtcactcccacagaggagggcttgagggtcctgacccagctggtggccacctacccccagggctttgtgaggtggttgggccccatcactcccatcatcaacttgtgccaccctgacatcgtccgatctgtcatcaatacctcagatgccattacagacaaggacatagtcttctacaagaccctgaagccctggctgggtaagtaactgtaggtggacgggacggggaccaacttttgtggccaggggaagattctgcccttgcccacagcctttggctgccgtactaggggatgggctcttgttaagtgttggtgacaagtggagacaccaccgtcgcttgtgacgcctgccttccatttcaacatcctgaagccctatataaagattttcagcaagagtgcaaacatcatgcatgccaagtggcaacgcctggccatggagggcagcacctgtctggatgtgtttgagcacatcagccttatgaccctggacagtctgcagaaatgcatcttcagctttgacagcaattgtcaggagaagcccagtgaatatattactgcgatcatggagctcagtgcccttgtagtgaaacggaataaccagttcttccggtacaaggacttcctgtacttcctcactccctgtggacggcgcttccacagggcctgcagactggtgcacgacttcacagatgccgtcatccaggagcggcgccgcaccctcactagccagggtgttgatgacttcctccaagccaaggccaagtccaagactttggactttattgatgtgctcctgctgagcgaggataaaaatggtaaagagttgtcagatgaggacataagagcagaagctgacactttcatgtttggaggccatgacaccacggccagtggcctctcctgggtcttgtacaacctcgcgaggcacccagaataccaagaacgctgccggcaggaggtgcaagagcttctgaaggaccgtgagcctaaagagattgaatgggacgacctggcccagttgcccttcctgaccatgtgcctgaaggagagcctgcggttgcatcccccaatccctacattcgcccgcggctgcacccaggacgtggtgctcccagacagccgagtcatccccaaaggtctatgaccccttccgcttcgacccagaaaacgcccagaagaggtcacctatggcttttattcctttctcggcggggcccaggaactgcatcgggcagaagttcgcgatggcaga

SEQ ID NO: 7487 - DNA, 4333 bp, Homo sapiens
atggcggggctctggctggggctcgtgtggcagaagctgctgctgtggggcgcggcgagtgccctttccctggccggcgccagtctggtcctgagcctgctgcagagggtggcgagctacgcgctgctgatgaagccggacgggcgagaattttttcagcagatcattgagtacacagaggaataccgccacatgccgctgctgaagctctgggtcgggccagtgcccatggtggccctttataatgcagaaaatgtggaggtaattttaactagttcaaagcaaattgacaaatcctctatgtacaagtttttagaaccatggcttggcctaggacttcttacaagtactggaaacaaatggcgctccaggagaaagatgttaacacccactttccattttaccattctggaagatttcttagatatcatgaatgaacaagcaaatatattggttaagaaacttgaaaaacacattaaccaagaagcatttaactgctttttttacatcactctttgtgccttagatatcatctgtgaaacagctatggggaagaatattggtgctcaaagtaatgatgattccgagtatgtccgtgcagtttatagaatgagtgagatgatatttcgaagaataaagatgccctggctttggcttgatctctggtaccttatgtttaaagaaggatgggaacacaaaaagagccttcagatcctacatacttttaccaacagtgtcatcgctgaacgggccaatgaaatgaacgccaatgaagactgtagaggtgatggcaggggctctgccccctccaaaaataaacgcagggcctttcttgacttgcttttaagtgtgactgatgacgaagggaacaggctaagtcatgaagatattcgagaagaagttgacaccttcatgtttgaggggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtataggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatttttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacatacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttcactgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctg

SEQ ID NO: 7488 - DNA, 2042 bp, Homo sapiens
gggcctccagtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgtcgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccctttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgagaattttttcagcagatcattgagtacacagaggaataccgccacatgccgctgctgaagctctgggtcgggccagtgcccatggtggccctttataatgcagaaaatgtggaggtaattttaactagttcaaagcaaattgacaaatcctctatgtacaagtttttagaaccatggcttggcctaggacttcttacaagtactggaaacaaatggcgctccaggagaaagatgttaacacccactttccattttaccattctggaagatttcttagatatcatgaatgaacaagcaaatatattggttaagaaacttgaaaaacacattaaccaagaagcatttaactgctttttttacatcactctttgtgccttagatatcatctgtgaaacagctatggggaagaatattggtgctcaaagtaatgatgattccgagtatgtccgtgcagtttatagaatgagtgagatgatatttcgaagaataaagatgccctggctttggcttgatctctggtaccttatgtttaaagaaggatgggaacacaaaaagagccttcagatcctacatacttttaccaacagtgtcatcgctgaacgggccaatgaaatgaacgccaatgaagactgtagaggtgatggcaggggctctgccccctccaaaaataaacgcagggcctttcttgacttgcttttaagtgtgactgatgacgaagggaacaggctaagtcatgaagatattcgagaagaagttgacaccttcatgtttgaggggcacgatacaactgcagctgcaataaactggtccttatacctgttgggttctaacccagaagtccagaaaaaagtggatcatgaattggatgacgtgtttgggaagtctgaccgtcccgctacagtagaagacctgaagaaacttcggtatctggaatgtgttattaaggagacccttcgcctttttccttctgttcctttatttgcccgtagtgttagtgaagattgtgaagtggcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtataggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaa

SEQ ID NO: 7489 - DNA, 2181 bp, Homo sapiens
ggggccgaggcggcgcgcggcgctgacagctgagtcggctcgcggcctcccggccccctcggcgcccggcccgaccctggcctggcctgccctgccccggagccatgagccccgggctgctgctgctcggcagcgccgtcctgctcgccttcggcctctgctgcaccttcgtgcaccgcgctcgcagccgctacgagcacatccccgggccgccgcggcccagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctgccgaccgcctgcttcacacccctcagcgctccctgtcgcctgcggactccatggcccttcctggactggcccttgcccaactcccagccaccaccactgtccctaccactgagcccttgcacaggccacttgctcagacgagacaccctaactcttgctcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgca

SEQ ID NO: 7490 - DNA, 1599 bp, Homo sapiens
ctcacagccgcagcagctgctgggcgcccaccgcgcacagctgggccccacaaacgtgatggcagccacagccctttcagtttccttctaggacacctcccctgcttttggaaaaaggatgaggttggtggccgtgtgctccaagatgtgtttttggattgggctaagaagtatggacctgttgtgcgggtcaacgtcttccacaaaacctcagtcatcgtcacgagtcctgagtcggttaagaagttcctgatgtcaaccaagtacaacaaggactccaagatgtaccgtgcgctccagactgtgtttggtgagagactcttcggccaaggcttggtgtccgaatgcaactatgagcgctggcacaagcagcggagagtcatagacctggccttcagccggagctccttggttagcttaatggaaacattcaacgagaaggctgagcagctggtggagattctagaagccaaggcagatgggcagaccccagtgtccatgcaggacatgctgacctacaccgccatggacatcctggccaaggcagcttttgggatggagaccagtatgctgctgggtgcccagaagcctctgtcccaggcagtgaaacttatgttggagggaatcactgcgtcccgcaacactctggcaaagttcctgccagggaagaggaagcagctccgggaggtccgggagagcattcgcttcctgcgccaggtgggcagggactgggtccagcgccgccgggaagccctgaagaggggcgaggaggttcctgccgacatcctcacacagattctgaaagctgaagagggagcccaggacgacgagggtctgctggacaacttcgtcaccttcttcattgctggtcacgagacctctgccaaccacttggcgttcacagtgatggagctgtctcgccagccagagatcgtggcaaggctgcaggccgaggtggatgaggtcattggttctaagaggtacctggatttcgaggacctggggagactgcagtacctgtcccaggtcctcaaagagtcgctgaggctgtacccaccagcatggggcacctttcgcctgctggaagaggagaccttgattgatggggtcagagtccccggcaacaccccgctcttgttcagcacctatgtcatggggcggatggacacatactttgaggacccgctgactttcaaccccgatcgcttcggccctggagcacccaagccacggttcacctacttccccttctccctgggccaccgctcctgcatcgggcagcagtttgctcagatggaggtgaaggtggtcatggcaaagctgctgcagaggctggagttccggctggtgcccgggcagcgcttcgggctgcaggagcaggccacactcaagccactggaccccgtgctgtgcaccctgcggccccgcggctggcagcccgcacccccaccacccccctgctgagggggcctccaggcaggacgagactcctcgggcaagggccgtgcccgcccacctctgctgcccacggccacccacccttctcccctgccccgtcccctgggccacccttcacgctggcttccagcgggccctctg

SEQ ID NO: 7491 - DNA, 3210 bp, Homo sapiens
ttctgtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaata

SEQ ID NO: 7492 - DNA, 1729 bp, Homo sapiens
acagagcgcgccgtcgccgctcgagctcgccctgagatccctccgctcagcgccttcaacgccgtgtcccggcaccccgcacccgggcacacaaaaaacgggtcgcccgcgattctcagggattgatcgcctcttcagaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgag

SEQ ID NO: 7493 - DNA, 2856 bp, Homo sapiens
atgaaacacgaaaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttg

SEQ ID NO: 7494 - DNA, 2950 bp, Homo sapiens
gctttgtcaaccaagctcaagttaatggatctggatactatgtatataaaaagcctagcttgagtctcttttcagtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgtgatatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgctgtgtacaacaatgctttgataaaatattttaagtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatcta

SEQ ID NO: 7495 - DNA, 2202 bp, Homo sapiens
tcattcagcctgggagaccacggtgacattcctgtctgcgctgcgggcaggccagcctctccggccctggactagggggcgccgccgagagaagccgccgcaggctgcagagtcgccgaccgcgctgttcgcaggcagaccccgggctgcccaccgcggcctagcgcgcgccggatggcaggagaagtgtccgcggccacgggccgcttttcgctggagcggttgggcctcccgggcctggccctcgccgcggccctgctgctcctggccctctgcttgcttgtccggcgcaccaggagacccggtgagcctccattgataaaaggttggcttccttatcttggagtggtcctgaacttacgaaaagaccccttaaggttcatgaaaacacttcaaaagcaacatggtgacactttcacagttcttcttggtggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaatttgatgacaagtttgcatatttagtatccaacatacccattgagcttctaggaaatgtcaagtctattagagagaaaattataaaatgcttctcatcagaaaagttagccaagatgcaaggatggtcagaagtttttcaaagcaggcaagatgtcctggagaaatattatgtgcacgaggaccttgaaataggagcacatcatttaggctttctctgggcctctgtggcaaacactattccaactatgttctgggcaatgtattatcttctgcggcacccagaagctatggcagcagtgcgtgacgaaattgaccgtttgctgcagtcaacaggtcaaaagaaagggtctggatttcccatccacctcaccagagaacaattggacagcctaatctgcctagaaagcagcatttttgaagctttacgactgtcctcatattcaaccaccattcgttttgttgaggaggatttgactctcagttcagagaccggggactactgtgtgcgaaagggagacttggtagccatctttcctccagtcctacatggtgaccctgaaatctttgaagctccagaggagtttagatatgatcgttttatagaagatggtaagaagaaaaccacctttttcaaaagagggaaaaagctgaagtgttacctaatgccgtttggaactggaaccagcaaatgtccaggccgattttttgcacttatggaaataaaacaattgttggttatacttttaacttattttgatttagaaataattgatgataagcccataggactaaactacagccgcttgttgtttggtattcagtatccagattctgatgttttatttagatacaaagtgaaatcttagagaagctaaaaggaaagaaaataaatctatcaaaattaccctaaacatcctaagctcatctatttctttttaatttctgcaaatgtaattgatttatttgtttaaaaagcgctaatttctatttgatctgatatcagtccagtttgtccttagtcacaaagcccatcataatataaaacaggatggtggcaggaaaatggacatcaaaatcaacttaagggtaggctcaaaacagggttgttgttgtttttttagtttctccttgttgtgattttcacctgttataataaatgtaccttcacaccaatagattgggcactgtggaatttaaatcactcaaattgttctctaatatgtaaaattacactttgaactactagaaaattgtgctggaaatggacacagtctaacaaattccaaattctcacagaagaaggaaattgaatttccatgagttacactggatgaaaatgttcccttcaagtataatattaataatacctatat

SEQ ID NO: 7496 - DNA, 3950 bp, Homo sapiens
gaaggtgcaagagctgtctgaaaaggtcagagcaaagcatgaagctggtgagcagctgtgaccatagctggaagcttctctctgagctttctcctggttacctcctcctcccctacgtgaccagtcagccaagtgttaagtccaggggaacattttgctgcttccaagtactgtctcactagtgttatttgccataacttgcggccacagggcaaggtccaggtgctcagacctttacatcctggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggctccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggtgaagctctttatcctgcttatggtcacacactttgacttagagttggtggaccctgacacaccactaccccatgttgacccgcagcgctggggttttggcaccatgcagcccagccacgatgtgcgcttccgctaccgcctgcatcctacagagtgagcttggccaagccagctgcaaacctggccagaggagttctattgcatctctcacctgttctcacccctctgcagccccaagaccccactggccacccctccctctggtcctgtggcaccccctacctctgttctgcctgtcctcgctctctccccgcctagtcatctgacaggcttatcattctctttaaaataccatctctcagagtgggttctgccgaaccctcctctcacaggaagtccagaggaagggggagtatctgtgggcaacttggtttgggagatgatgcctgccttgagaagtcctgagtacagagactggttccccccagacacgagtaacatggcatcttgcaaacatcagcctccactctcccagcttgctttagttttttcagcaacacttatcccacatcctatggaattcaggttctagaacagtgtcatccaacataaatatgaagcaagctacatgagtagtggggttttttggttttgtttgtttgttttgagacagagtcttgctctgtcgccgaggctgcagtgcagcggtgcgatctctgctcactgcaacctctgcctcctgggtttaagcaattctcctgcctcagcctccccagtagctgggattacaggcacctaccaccttgcccagctaatttagtttcctggtaaacacatttttaaaaagtaaaatgaaacaattcatttttataatatactttacttaatccaatatatccaaaatattggcatttcaacgtgatcactattaaaaattttaacgtaatagtttttaccttccctttttcatcctgtcttcaaagtctggtatgtactgtacttttgcagttcttcccagttcagactagccacattccaagtgcttaattgccgtgtgtggcaggtggctgccctattggatagcacaggtctagagaaatgatacctttttttttttttgagacagagtctcactctgttgcccaggctgcagtgcagtggtgtgatcttggctcactacaacctctgcctcccgggttcaagtaattctcctgcctcaggcttctgagtagctgggattataggtgcgcaccaccacacccggctagtttctgtatttttagtagagacggcgtttcaccattttggccggcctcctcggcctcccaaagttctgggattacaggcatgagccactgtgcccagtcaggatgtctttaatgtaggaatcattcaagatccctcctcagtgcccatgtctcccccacctcagggtgctgtcaaccctcccttggtttccatgatcattgctgaactcagagctttcttctatccccagacccacatgggagtctcccagcacctctgactcagcttggccaatgcagaacttggcatctgaacccctgcctcttccctgaaccactcctcctcctgatttccctgctctctctgctcagaacactaccattcaccccatctcccagagacactctccctcctcctctttcaccttcatacaagcaggcccccgtcctatcagtacacccccctgtgatgcctctgaaatatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttagtctccaaacttctcaactttgccagctttctccaatgaaaccatcagtagagacattgctgttcctgcccatcccagtgccagctactccttcctggaagccttcctggatttcacgcatcccatcctctggccagaaatggcctccgaactgtgcagctcctgcagcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctga

SEQ ID NO: 7497 - DNA, 1951 bp, Homo sapiens
cccggcgcgcacagacacacgctccctccctccgcgctctacccctcgcccgcccgccgcgcacgcagccggccccggctcccggcgccccgcgccccgcgccccgcgccccgccaccgccgccgccgagcaaagccgggctgggcttggagctgctcatggagaaagtgccaggcgagatggagatcgagcgcagggagcggagcgaggagctgtccgaggcggagaggaaggcggtgcaggctatgtgggcccggctctatgccaactgcgaggacgtgggggtggccatcctggtgaggttctttgtgaacttcccctcggccaagcagtacttcagccagttcaagcacatggaggatcccctggagatggagcggagcccccagctgcggaagcacgcctgccgagtcatgggggccctcaacactgtcgtggagaacctgcatgaccccgacaaggtgtcctctgtgctcgcccttgtggggaaagcccacgccctcaagcacaaggtggaaccggtgtacttcaagatcctctctggggtcattctggaggtggtcgccgaggaatttgccagtgacttcccacctgagacgcagagagcctgggccaagctgcgtggcctcatctacagccacgtgaccgctgcctacaaggaagtgggctgggtgcagcaggtccccaacgccaccaccccaccggccacactgccctcttcggggccgtaggacccctaactccacccccctccctggcagcacctcgagcagaaggccgagttctgaagaccctccttgacgctccatttctgggtgccaaggaagctggaggaatccctgactcaacttccccgaaggaggcctctgtggcggccagggtccccccctggagctgctgggaggcggcgctggctgcctggatgctgaccccagcgcggcgggcagagcggggcccactcttcttagcttttctactcactgttagagagagacctagctgagcggctggcaggaagcgggacaggtctaggagtcccttagggaataaaccagccccgtttctatcagcccggccagcatgcaggtctccacatcaccatctagagtatcacgcacacatctaccatatatacagatatattctatatacgagctatatataaatatatatatacatatatatatacacacatacatatctagaatgtgtatccgcggcgcccagaagcctcggtttggcccacctgtgagtggggcagggaggggttccggttgtgcagagaacagagtgttctggcaaagaggaaatcccacagcagcgcagaggacctgggcctggaggggcagggctggggcaacccggcttggcggcaaagcccagccccttctcagaccagctccccacattcctgaattccacttccaggcagaaaggagtgggctccccctactccctcagaggaactgactcaccggctgtcctagaatgggcaggggcagagcgaagttctgggtgggatgaccgcactgggggaggggcctcagtccagaaacctcgaccgctagctccacctgccttggccaccagggcagccccgggggatccgggctgctgggcagcaggtcggcgggaccacatgcctgggtctcaccctcagctccgagggccgagggctttccccaccccaccctcctcctggccggcagtcggccctgtctattcatctgcgtcaggcttgccaggggggccccccgtgtgtgccccttggtcacgtgtgtcgtcttcaaggatgttttgctgctgtggctcctgctgtgtcccctcctggcccatcctcatcctcatcttcatcctcatcctcatctgtgcaaccgcccgtcctccttttctagtttctgatgtttgtaaccagacccagctgtgtcattaaacagacccgttcttgctg

SEQ ID NO: 7498 - DNA, 1298 bp, Homo sapiens
cggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctccc

SEQ ID NO: 7499 - DNA, 3311 bp, Homo sapiens
gcgagcgggggcgcgggtggcgcggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctgtctggccgtctcgccccgcccctccacaggaccctggaccagggcggtgcagggcgcagccctgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagcca

SEQ ID NO: 7500 - DNA, 1217 bp, Homo sapiens
gcgagcgggggcgcgggtggcgcggcgggacgcgagcggcgagccggagcgcggagcccggctcccgcaccatggaggaggacgacagctacgttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcgcaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaagttccaggtcagcccaggagagccatag

SEQ ID NO: 7501 - DNA, 3311 bp, Homo sapiens; identical to SEQ ID NO: 7499

SEQ ID NO: 7502 - DNA, 1510 bp, Homo sapiens
agtttaaccctaatggctacacaggagagaagcggcatgaatagacgggtttcccagggtgcggacggtgctttcccagaaactcccgggctgtgagttcccagtgacctgacagcagaggagcgtcaagaactggagaacatccgacggagaaaacaggagctgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcaca

SEQ ID NO: 7503 - DNA, 1551 bp, Homo sapiens
acactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggctgacattcagaggctgaaggatgagatagcagaagtagctaatgaaattgaaaacctgggatccacagaggaaaggaaaaacatgcagaggaacaaacaggtagccatgggcaggaaaaaatttaatatggaccctaaaaaggggatccagttcttaatagagaacgacctcctgaagaacacttgtgaagacattgcccagttcttatataaaggcgaagggctcaacaagacagccatcggcgactacctaggggagagagatgagtttaatatccaggttcttcatgcatttgtggagctgcatgagttcactgatcttaatctcgtccaggcactacggcagttcctgtggagcttccggctacccggagaggcccagaagatcgaccggatgatggaggcgtttgcccagcgatattgtcagtgcaataatggcgtgttccagtccacggatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccggaatctctatgagagcataaaaaatgaaccctttaaaatcccagaagacgacgggaatgacctcactcacactttcttcaatccagaccgagaaggctggctattgaaactcggaggtggcagggtaaagacttggaagagacgctggttcattctgactgacaactgcctttactactttgagtataccacggataaggagccccgtggaatcatccctttagagaatctgagtatccgggaagtggaggactccaaaaaaccaaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaaagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtg

SEQ ID NO: 7504 - DNA, 2260 bp, Homo sapiens
agaggtcacatgggctctttctgctttgctacttttgattacttgtcacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcgtgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaa

SEQ ID NO: 7505 - DNA, 1464 bp, Homo sapiens
ctttactgcctctctccagccagctccagcactacaggacagagattggaattaaatgtcacgtggaaaaaagccaacatggcattctgttaagaagatagacaacctaagtgacgtctatcctgcttcaaagacaaaactcaggaggctgtacattcatttagagcagagtagacgaaacctcctattctctggcttgggaaccaggaggaatcactgactgagatttgccaaccagacctctatgaagtgagctctatcacatggtacgtttatgagaagaggaaccagcaatgtttccttccatcttcaactatactaacaagatccatctgatgtcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataata

SEQ ID NO: 7506 - DNA, 4607 bp, Homo sapiens
atacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctggcagggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggcctgctgaccccctcatttcttggggttgacagagtcgaggtgctccgtggagccagcctgtttccctggacaggggcctggacccgcctgtctctgggtgctgcctgggctgtcccggtgggtctgttctggtttcaccccgagcccagcaggagtggagtaaagggagaaggttaatatggtgggagtctggagttggaattggccggggacagagtttagaatgcagggattcagggtcaaggtctagcattcattctagaagttacttgacagccatcagccagttacgctacagccatcagctagttcccatcgttgctttcatggggcttgaggtctttgaggggcaggagatgaagctggtgaggttgtgagctgggccagggctttgaggacaacctggagctggaagaacatgcgaccacctcagggagggtcagggaaggatgagtggggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggccacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgattttttttgtaggtttttttttttgttttttgttttgttttgttttgtttttgagagggagtctcactttgtgccctagactggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatattggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataaggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagca

SEQ ID NO: 7507 - DNA, 1848 bp, Homo sapiens
cctttgagcaggcgcagaggtggctgtaccgcgtggctccgcctccgcgcgacacttttccggggcttctcattggagagcaagcctgtcaagtgctttctgttgtttcggaggcggggcctgctgccctgcctgcactccgattggccccgcgggccgtctacctctggccggacatacctacaccggctttttgtacgactgttggccctggagaacgatcctttggtggcgagggcggggaggacgaaagcgcccactgtggattggacagtgtcaaaaagaggggcggtccctactgaaggggcggttgggcgacgaagggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctggggggccgggtgaagacgtggaagcggcgctggtttatcctcacagacaactgcctctactactttgagtacaccacggacaaggagccccgaggaatcatccccctggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaacc

SEQ ID NO: 7508 - DNA, 4505 bp, Homo sapiens
ggaggaggcccggccgcgacccgggccgcgcgctgaggagccgcccggtcgcctgcgcgctccctccggcggcgtccccagcccgcggcccctctgctgccggcccccggctcgccggctgcgggagtggcctcaagatggatgaagacggcggcggcgagggtggtggcgtgcctgaagacctctcattagaagagagagaagaacttctagacattcgtcgaagaaaaaaggaacttattgatgacattgagaggctgaaatatgaaattgcagaggtgatgacagagatcgacaatctaacttccgtagaggagagcaaaacgactcagaggaacaaacagatagccatgggaagaaagaaattcaacatggatcccaaaaagggaattcagtttctaatagaaaatgacctgctacagagttccccagaagacgtcgcccagttcctttataaaggagaaggcctaaataagaccgtcattggggactacctgggtgaaagggatgaatttaatattaaagttcttcaagcctttgttgaactccatgagtttgctgatctcaaccttgtacaagccttaaggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggggagccccgcggggaggcggcggcgactgccacagcccttccagcctgtcttgctggccgccctggttcatatttgagtttaattgtactgaccctggacccagataagcagcaactttgtgtctttggggtcacagaacattttggggcagtttaatgtggtaccaaactgaaaataggagctatttatagatggagcagcacttagtgcttcatagaaagcaatgcctatttttaaagttacaaacgcagatatctacatagatatgctttgctgagaagttaggtctgtggtagaccagaaaccacaaattgactttttttcttagaaaatatttctatttgcggtaaatatagtaatatgtaaataatgtacatctgttgatttctggagtgtctgttattcaatgatgtatatactcccacagctcgcatgaaggaacagcctctattgatacttggttgtaaagtgaagtaagattggagggtggatggctgtcagagctcttgcagatactgtgttcactaaataaaaatcacatgtattgttaaaacaa

SEQ ID NO: 7509 - DNA, 1171 bp, Homo sapiens
agcactcagcagcatccgggggagaggaggcagggcttctggtgggagtcgcctcagccggcccttggactaagaaaatcaggccgcacctcgtcatcttctcaaatcttcggcttcataccttgttctcgtttacgtggactgtttgctcatggccttacctcaactgcagactgcaatgttggcagcgtttttgtgggaccctcgtgatgttgtgctcacagcgcagcctggggctgaacagtgcgctgagagttcgcaacatataagaatcctgcagccgcagttcaggcttatcagattgcgtttctggaagctgtacatccagagaagggtgcaggcctggcagttcttatggagcttcaggctgcccggggaggcgcagaagattgatcgcatgatggaggctttcgcttctcgctactgcctgtgcaaccccggggtcttccagtccacagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgaggaatttgtatgagagcattaagaacgagccatttaagatcccggaggacgacgggaacgacctgacccacaccttcttcaaccccgaccgcgagggctggctcctgaagctgggagggcgtgtgaagacctggaagcgccggtggttcatcctgaccgataactgcctctattactttgaatacacaacagataaggagcccaggggaatcatcccgttggaaaacctcagcatcagggaggtggaggacccccggaaacccaactgttttgagctctacaatcccagccacaaagggcaggtcatcaaggcctgtaagactgaggccgacggccgcgtggtagaggggaaccatgtggtgtaccggatctcagccccgagcccggaggagaaggaggagtggatgaaatccatcaaagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaag

SEQ ID NO: 7510 - DNA, 3202 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgccttttgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtgccctctgccaagtcatgcccattctctagttcttgcaaaactgcagtgtttggactagaaacgtattggcccctgctagccctgtgctccagcttccagctggagatggcagccgttgtttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggctgcctggaggcagtggctgagccagaaagtaacacagagctcatgcttggagagagagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggccgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggacaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 7511 - DNA, 636 bp, Homo sapiens
gcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcagattccgagaaggagcatctgatctgggctttggagggtgagtaggagttcacaatacagagaaggaagaagccaccaccatccagtgttctctaactcccagctctttaagggagaggg

SEQ ID NO: 7512 - DNA, 3253 bp, Homo sapiens
aagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgccttttgagcgctttgtgtccatgaaccgcggcatcaacaatggtagcgacctgcccgaggaccagctgcgggttacatgggagtgctcccagaggagaagccgggaaaggacatttcaaaaagaagaagtggccagaacggaggcgtgtcctgattgggaaaggagaggtgtccagtgtggccgagaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtgccctctgccaagtcatgcccattctctagttcttgcaaaactgcagtgtttggactagaaacgtattggcccctgctagccctgtgctccagcttccagctggagatggcagccgttgtttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggctgcctggaggcagtggctgagccagaaagtaacacagagctcatgcttggagagagagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggccgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggacaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaactcgtga

SEQ ID NO: 7513 - DNA, 569 bp, Homo sapiens
cacacacacttccggaagcctctccagcagggacagccaagccggggacagcgcctccagggcagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacct

SEQ ID NO: 7514 - DNA, 652 bp, Homo sapiens
aagtgggagttggaagagagcttgtggggtggaacacagggggccctgctaggactgtccaagttgggcgctcctatggcatatatgtgaggaggctgccacgtgaatgcccatggtcccctggaaaatgttcgtcctcagtgaacatcgccctcggtgtctgtgcatgtggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagag

SEQ ID NO: 7515 - DNA, 2043 bp, Homo sapiens
cccgctcgtctggcccgcccccctcgccctcgcaggcggtccgcgccactgcctctcagtccctgtcctgcgcccgcgcgccccgggagcctacccagcacgcgctccgcgcccactggttccctccagccgccgccgtccagccgagtccccactccggagtcgccgctgccgcggggacatggtcctctgcgttcagggacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttatttta

SEQ ID NO: 7516 - DNA, 2167 bp, Homo sapiens
tccctgtcctgcgcccgcgcgccccgggagcctacccagcacgcgctccgcgcccactggttccctccagccgccgccgtccagccgagtccccactccggagtcgccgctgccgcggggacatggtcctctgcgttcaggggtgagcacccccttgtaagctcagggctactgttgggtgtcagggaacaaagttttagactgctgcgctccaaagcgggcacacacatgtacctagaacacaccagccactgtccccaccatgatgatgacacagccatggacacacccctgcccagacctcgtcctttgctggctgtggagcggactgggcagcggcccctgtgggccccgtccctggaactgcccaagccagtcatgcagcccttgcctgctggggccttcctcgaggaggtggcagagggtaccccagcccagacagagagtgagccaaaggtgctggacccagaggaggatctgctgtgcatagccaagaccttctcctaccttcgggaatctggctggtattggggttccattacggccagcgaggcccgacaacacctgcagaagatgccagaaggcacgttcttagtacgtgacagcacgcaccccagctacctgttcacgctgtcagtgaaaaccactcgtggccccaccaatgtacgcattgagtatgccgactccagcttccgtctggactccaactgcttgtccaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcccgcagcctgcaacacctgtgccgccttgtcatcaaccgtctggtggccgacgtggactgcctgccactgccccggcgcatggccgactacctccgacagtaccccttccagctctgactgtacggggcaatctgcccaccctcacccagtcgcaccctggaggggacatcagccccagctggacttgggcccccactgtccctcctccaggcatcctggtgcctgcatacctctggcagctggcccaggaagagccagcaagagcaaggcatgggagaggggaggtgtcacacaacttggaggtaaatgcccccaggccgcatgtggcttcattatactgagccatgtgtcagaggatggggagacaggcaggaccttgtctcacctgtgggctgggcccagacctccactcgcttgcctgccctggccacctgaactgtatgggcactctcagccctggtttttcaatccccagggtcgggtaggacccctactggcagccagcctctgtttctgggaggatgacatgcagaggaactgagatcgacagtgactagtgaccccttgttgaggggtaagccaggctaggggactgcacaattatacactatttatttatttattctccttggggttggtgtcaggggcgagccaaccccacctctatgccctgagccctggtagtccagagaccccaactctgccctggcttctctggttcttccctgtggaaagcccatcctgagacatcttgctggaaccaaggcaatcctggatgtcctggtactgacccacccgtctgtgaatgtgtccactctcttctgcccccagccatatttggggaggatggacaactacaataggtaagaaaatgcagccggagcctcagtccccagcagagcctgtgtctcaccccctcacaggacagagctgtatctgcatagagctggtctcactgtggcgcaggccccggggggagtgcctgtgctgtcaggaagagggggtgctggtttgagggccgccactgcagttctgctaggtctgcttcctgcccaggaaggtgcctgcacatgagaggagagaaatacacgtctgataagacttcatgaaataataattatagcaaagaacagtttggtggtcttttctcttccactgatttttctgtaatgacattatacctttattacctctttattttattacctctataataaaatgatacctt

SEQ ID NO: 7517 - DNA, 1802 bp, Homo sapiens
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgctgtgattgtg

SEQ ID NO: 7518 - DNA, 702 bp, Homo sapiens
atggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagacacagtcccgctctgtcacccaggctggagtgcagtggtgcgatctctgcttgctacaaccttcgcctcccaggttcaagcgattctcctgcctcagcctcccaagtagctgggattacaggcacccgccaccacgcctggctaatttttgtattatcagtagagacggggtttctccatgttggccaggctggtctcgaacttgcgacctcaggtga

SEQ ID NO: 7519 - DNA, 771 bp, Homo sapiens
atggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggaggtaa

SEQ ID NO: 7520 - DNA, 770 bp, Homo sapiens
ggcatggggcggctggttctgctgtggggagctgccgtctttctgctgggaggctggatggctttggggcaaggaggagcagcagaaggagtacagattcagatcatctacttcaatttagaaaccgtgcaggtgacatggaatgccagcaaatactccaggaccaacctgactttccactacagattcaacggtgatgaggcctatgaccagtgcaccaactaccttctccaggaaggtcacacttcggggtgcctcctagacgcagagcagcgagacgacattctctatttctccatcaggaatgggacgcaccccgttttcaccgcaagtcgctggatggtttattacctgaaacccagttccccgaagcacgtgagattttcgtggcatcaggatgcagtgacggtgacgtgttctgacctgtcctacggggatctcctctatgaggttcagtaccggagccccttcgacaccgagtggcagtccaaacaggaaaatacctgcaacgtcaccatagaaggcttggatgccgagaagtgttactctttctgggtcagggtgaaggctatggaggatgtatatgggccagacacatacccaagcgactggtcagaggtgacatgctggcagagaggcgagattcgggatgcctgtgcagagacaccaacgcctcccaaaccaaagctgtccaaatttattttaatttccagcctggccatccttctgatggtgtctctcctccttctgtctttatggaaattatggag

SEQ ID NO: 7521 - DNA, 1003 bp, Homo sapiens
ggcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagccctcggagccatgtgtgagatacctgcccaggctgtacctggacatacacaattactgtgtgctggacaagctgcgggactttgtggcctcgcccccgtgttggaaagtggcccaggtagattccttgaaggacaaagcacggaagctgtacaccatcatgaactcgttctgcaggagagatttggtattcctgttggatgactgcaatgccttggaatacccaatcccagtgactacggtcctgccagatcgtcagcgctaagggaactgagaccagagaaagaacccaagagaactacagttatgtcagctacccagacttaatgggccagagccatgaccctcacaggtcttgtgttagttgtatctgaaactgttatgtatctctctaccttctggaaaacagggctggtattcctacccaggaacctcctttgagcatagagttagcaaccatgcttctcattcccttgactcatgtcttgccaggatggttagatacacagcatgttgatttggtcactaaaaagaagaaaaggactaacaagcttcacttttatgaacaactattttgagaacttgcacaatagtatgtttttattactggtttaatggagtaatggtacttttattctttcttgatagaaacctgcttacatttaaccaagcttctattatgcctttttctaacacagactttcttcactgtctttcatttaaaaagaaattaatgctcttaagatatatattttacgtagtgctgacaggacccactctttcattgaaaggtgatgaaaatcaaataaagaatctcttcacatgagaaa

SEQ ID NO: 7522 - DNA, 6863 bp, Homo sapiens
cgggaggaaggggaggaggccgagtgtttcctggcgcattcccggccagcccgagtgactcactcggccaaggaaactcccagggcccgcccaggacccccaagccgccgcggacgcagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtcattagtgcattcggcttttggagaagggatgaaaatgtaaaatacttctacaacaataaaatgttaatagaaa

SEQ ID NO: 7523 - DNA, 4460 bp, Homo sapiens
gttgacccgcgtggggcccgggcatgactggacacgcccccaggcctctcctggcactatctgggttcaggccgcagaaagggcagactgcgggactctgggctggagtcgcaggacacgggcagcccctatggggccgaagcacgtcctcaggcagcctggcccctccgagcggcatcaccctgaggtgcctgcgtggacaccaagggcaggccccccatgctggctctgcaggcagcgctggggctggaccctgcacccacccggccggggctgccctgcactgctcctttctgagcccaggatggcggcccaggtgactctggaggacgcgctgtccaacgtggacctcctggaggagctgcccctgcccgaccagcagccctgcatcgagcccccgccatcctcgctgctctaccagaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatct

SEQ ID NO: 7524 - DNA, 5674 bp, Homo sapiens
ccggtttaatccacaccgctgcgtctgtcctccgtcctggggctggtcttctccctcatctctgccggaggcttttaatctcttctgccactcttctggaaagtcaccagcaatgcacgctgctggctctgcaggagggtcagggggacggccctcggcctgtgcgtggtgccagccaccctccctgcctccctctgcgtgcgtcccgtgtccctgcctggggtgtgtgtgtcgagtgactaacgtctctctcctgcctctccctcctgtctgtccgtgtctagctctacctggtgcgcaccatggccgagtccttgggctctgccgagctgctcaggcagctcaagtctctgggcatggagaggctcttgcatgcggttaacacgtttctgaggcagtcgtgcacctacctaccccttttaacctttggtggtaagacatcatttgtttctcttgacgtttatggcacggaggcgaactgctccgctacaagttgttctttccccaaagcagcagcaacgtggccgcgtagacaggcacccggacccctcggggagctggtgcggggccctcccgaccagggcgtagcggagcagtccttctctcatgggctttttgagtttggcataactaatgtaccatgtatattttctcccccacaaatgtttccttggataatccagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatctatttgtgttcatttatttactctaaccctgtgctgcctggcttggcaaggaactctaacctgaactcacataccaggccagctgggatggaggtcacctctaaggctgaggtgggatgggaccgtgacaccatcccatataccgctcacctcagcacaggtttagctttatatttagggttccgcaggcaaatgaggtgtaaaacggccgtgttggctgctccaatctggatatgaagaggctactcagtgcctctctgttacctgtgcccatgacctggaggaagccagcaatgtgggaggagatcagtcaggcccagtgggtgctgcacaaagggaccgggagcaccgagtccagccttcagctgtccccgatccacagggctcacatggctggagctggttcacatgatctgtcagaatgaaaaacaatcggtctagactaccagtagagtcacgaacatgtttgagaaactaaagccatattttaaaaagtactaaggcaatgaggttctgaaaatcctaactaactgaatggaaaaagatgctatgcctgtttattgtagatgaatactacagataaacacaagtccagcatgattaactgaactcactttatattgtagcctggcagtcattttacattatttggagtattgcaaccttcaccaattttaaaattttctatggatgccaagttgccataaaaagcaggcctcgcctacttttccggaggcctttggaaactgtccagaagcatatgatgcacggcacagaaaagtagtaagtgtacgaaccatcctgttacactgccaaactcactcaagtgacatgaagcctaacaaacaattattctttctttataaaaagttccctaaaaatgcttttggtaatgtgaattaataaccctggggccagcattctgctgcagatttagaggtggtagctgtgcttatcttagaaactacagaataggatgaaaaattatggtaaaacttaatcaattaccaagttttataaggcttaattatataccaaatatgtaataccttaggtataagacaatctcaagtgctacaaaatgttaaataagaatttattatttattaacctatgcatgttcaaatgagtctctgtcctcaagggggagaaaactggttcttttatgtacaaagcacagatgtaggtacagtatataaacagatacgtagtacatctgtagtattaaaatggcatgggaggaggcagttagaaaaaacatctaaaacagctccttagaaggccaataataaagttggaaaaaagggagtttccacgcagccagtggtgagctgcatgggataccagcaccattggcaggggaggccctcggggagtgatggcttggcgctggcgcaccactgggtaacctccaggcaggagccacaggctggaacaggcgaacactttcttcccatcacctaggtggaaattaattctgccaatacttttttttaaaggccagtcaatggttatgagtggataggttcaaagctgaatggagttcattagaccttttttattattctaccttttctgcatatgtttgcagttttccatcgacttcttcataaacaaacattttctagaaaccaaaatatgtagtggcccaaaggagctcttaagcaaagtacttggtacaaagagaccatattctataaacatgttaagtttgttctaagcattcagacttttagaataagaacttcatttcaactttttattataacatgagctaaatttaagaaacaaccctagtcttctatttcccagagctgttcaaagtctaaatgacaatataactcattatgaaaatatactgaaaagtacaagagctgatgtaaaacggtaatcaaggttccaggcatcatgggattagggtaactgaagaataaacccagccaggctgcaacagcaggcaggatgtgctggcttgatgaggtgctaaggccatcgaatgctcagaggaagccggattcacggtgatcatctcaacctgagaaatcgttccttggggtgatttctgcccttttttttgttttgtaagaaagaggttccttcattcagtaacttagttttcccttaataaatatttcaaaaataaaaccaatcatcatcaaacaaacaggagccacttttgtaggtaaggtaaatcacaggataatgtattgggataactctgtttttttaaaataaaaaagccttacatggtcagggattgatggagtggggatgacaaatgcacatttcagactttcatcaccaatgaaaaaataaagcattttcatagacttaaaactgtc

SEQ ID NO: 7525 - DNA, 4515 bp, Homo sapiens
agtgactcactcggccaaggaaactcccagggcccgcccaggacccccaagccgccgcggacgcagaatgtggctcagctgcccctggtcccatcccagggcagagctcctcctgagtacccttgagactggagcagattcagcagaaggcagattgccccctctccctggagctggctctgaagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactgggcaaattcatcaacatgttcgctgtgctggacgagctgaagaacatgaagtgcagtgtgaagaacgaccactcagcgtacaagagggccgctcagtttttacgtaaaatggcagatccacagtccatccaggaatcgcagaatctgtccatgttcctggccaatcataacaagatcacacagtctctgcagcagcagctcgaagtgatttctggctacgaagagctcctggcagatattgtgaatctgtgtgtggattactacgagaacaggatgtatttgacgcccagtgagaaacacatgcttctcaaagtcatgggatttggtctgtacctgatggatgggagtgtcagtaacatctataagttggatgccaagaaaagaataaacttatccaaaatcgacaagtacttcaagcaactccaggtggttccgctatttggggacatgcaaatagaactggcaagatatatcaagaccagcgcccactacgaggaaaataaatctcgatggacgtgcacatcctccggcagcagccctcagtacaacatctgcgagcagatgatccagatccgcgaggaccacatgcgcttcatttcggagctggcgcgctacagcaacagcgaggtggtcacgggctcgggccgccaggaggcccagaagacggacgcggagtaccgcaagctcttcgacctggcgctgcagggcctgcagctgttgtcgcagtggagcgcgcacgtgatggaagtgtattcctggaagcttgtgcaccccaccgacaagtactccaacaaggactgccccgacagcgctgaagagtacgagcgtgccacgcgctacaactacaccagcgaggagaagtttgccctagtggaggtgatcgccatgatcaaaggcctgcaggtgctgatgggcaggatggagagcgtgttcaaccacgccatccggcacaccgtctatgccgcactgcaggacttctcccaggtgacccttagggagccgctgcggcaggccatcaagaagaagaagaacgtcatccagagtgtcctgcaggccatcaggaagaccgtgtgtgactgggagacggggcatgagcccttcaatgacccagccttgcggggcgagaaggaccccaagagcggcttcgacataaaagtaccacgccgcgccgtgggaccctccagcactcagctttacatggtgagaaccatgctagagtccctcattgcagacaaaagtggttccaagaaaaccttgagaagtagccttgaggggcccaccatattggacatagaaaaatttcatcgagagtcattcttctacactcacttgataaatttcagtgaaacgctgcagcagtgctgtgacctttcgcagctgtggttccgagagttcttcctggagctgaccatgggcaggaggatccagttccccattgagatgtcgatgccctggatcctgacggaccacatcctggagaccaaggaggcatcgatgatggagtacgtgctctactccctggacctgtacaatgacagcgcccactacgcgctcaccaggttcaacaagcagttcctgtacgacgaaattgaggccgaggtgaatctatgttttgaccaatttgtttacaagctagcagaccagatatttgcctattataaggttatggcaggaagtttgcttcttgataaacggttacgatcagaatgcaagaatcagggagccacgatccacctcccgccgtctaaccgctacgagacgctgctgaagcagaggcatgtgcagctcctcggcagatcaatagacctcaatcgtctgatcacccagcgcgtctcagcagccatgtataagtccctagaactggcgattggacgatttgaaagtgaagatttgacctccatagttgagctggatggcctgttggaaatcaaccgcatgacccacaagctgctgagccggtacctgacgctggacggcttcgacgccatgttccgggaggccaaccacaacgtgtcagcgccctacgggaggatcaccctgcacgtcttctgggagctcaactatgacttcctgcccaactactgctacaacggctctaccaaccggtttgttcggacagtgttaccattttctcaggaatttcaaagagataagcagcctaatgcacagcctcagtatctgcatggatccaaggctttgaacttggcctactccagcatttacggcagctaccggaacttcgtgggacctccacactttcaagtcatctgccggcttctcggctaccagggtatcgccgtggtcatggaggagctgctgaaggtcgtcaagagcctgctgcaaggcacaatcctgcagtacgtgaagacgctgatggaggtgatgcccaagatctgccgcctgccccggcacgagtacggctctcctggtatcctggagttcttccaccaccagctgaaggacatcgtggagtacgcagagctgaagacggtgtgcttccagaacctgcgggaggtggggaacgccatcctcttctgcctgctcatcgagcagagcctgtctttagaagaagtgtgtgacctgctgcacgcggctcctttccagaacatcttgccgcgagtccatgtgaaagagggggagagacttgatgccaaaatgaaaagactagaatcaaagtacgccccgctgcatcttgtcccactgattgaaagactggggacccctcagcaaattgccatcgcaagagagggggacctgctgacaaaggagcgcctctgctgcggcctgtccatgtttgaggtcatcctgacacggatccggagctttctggatgaccccatctggcgcgggcctctgcccagcaatggggtcatgcatgtggacgagtgtgtggagtttcacagactgtggagtgccatgcagtttgtctactgcattcccgtggggacacacgagttcacagtcgagcagtgctttggtgatgggctacactgggctggctgtatgatcatcgtacttcttgggcagcagcggcgttttgctgtgctggatttctgctaccatctacttaaagtccagaaacatgatggcaaagatgagattattaaaaatgtgcctttgaagaagatggtggagagaattcgcaagttccagattctcaatgatgagatcatcaccatcctggataagtacctgaagtcaggcgacggggagggcacgccagtggagcatgtgcgctgcttccagccgcccatccaccagtccctcgccagcagctgagggcacgcgctgcactccgtaactcaacatggcatgcctttctctccgtaaactatttagtgagatttttagggactatttttcagtatctctgtacctgttaaagggggtgcttttcgatctaaaaacttaattttataaaattgacttatttttctagactaaaattgtatatgcttttggtaattaggaactcttgagaatattggctgctgattgttgccatcacgttcctacaaaattgtttttctatgggatgttctggcagctgtgtcataaaatgctgctgggttcattcattcattccataagaaacttaataccagcaaatgcattaaatcccttgccagttaccattaactgtaactatttagcttttgtttagggatctttctgatggtcttttatgagcaatcttagttctaagtcattgttcccatcccttttttgtgtgtttcagaaaatagtgaacttgattcccctgcttccactaaatccagttgtgacaaaatctaacgtgacatcagatcgaaaggttatagaaataaaactaatgagatct

SEQ ID NO: 7526 - DNA, 544 bp, Homo sapiens
agttttcctaaacacgcctgtgaccagctgactccactcagcgtttccgtgtgagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggacttcgtgtcagaagcctacctgatcacactg

SEQ ID NO: 7527 - DNA, 582 bp, Homo sapiens
gtgtttcctggcgcattcccggccagcccgagtgactcactcggccaaggaaactcccagggcccgcccaggacccccaagccgccgcggacgcagaacaggggtccttatgtgttgttccagcccaggatggcggcccaggtgactctggaggacgcgctgtccaacgtggacctcctggaggagctgcccctgcccgaccagcagccctgcatcgagcccccgccatcctcgctgctctaccagccaaatttcaacactaactttgaagacagaaatgcatttgttactggcatcgcaagatacattgaacaagccaccgtccactctagcatgaacgagatgctggaggagggccaagaatatgctgtcatgctgtacacctggaggagctgctcccgggccatcccacaggtgaaatgtaacgagcagcctaacagagtggaaatctacgagaaaaccgtggaggttctggagcctgaggtcacaaaactgatgaatttcatgtacttccagagaaatgccattgagcgtttctgcggggaagtgaggcgcctgtgccatgccgagaggaggaaggac

SEQ ID NO: 7528 - DNA, 6573 bp, Homo sapiens
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattcccagggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccagcaa

SEQ ID NO: 7529 - DNA, 6791 bp, Homo sapiens
ggacccgccgcagagccaggtaagcggccctcgcaggcctcgggccgggcacggggactaggatgccgccggggacggggatgaggccgtgaggatgcgcgaagggccgccccctctcccggcccgcggggggcgctcggcgctgtgcccgggctagcccgaggcccggcctcaggccccacgcggcccctttccccctcggacccaccgtgcgtcccgcggcacggaccctctgcccgggaggcgcgggcacatcgcggagctccggcgcggcggcgggggagccgcagcagcaggtgcgcggcctgggccggagccgccagcccgggaggaggcggtgctaatctcagggaccggagacacctgcagcggccgcgagcccggcagcggcgacatcctcgagtccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattcccaaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccagcaa

SEQ ID NO: 7530 - DNA, 6615 bp, Homo sapiens
ggaagggcctcttcctctgtgagaattcagcattttgcaaccatccaaaaatgttgagggcatgctttgcttccagggcagacagagcagcacagtgagcatgggacacaggatccctgacttgctgtgtgcccttaaaccagccactacctctctgacgttcaaaattgagcaatggaaggcagcctgcccaactgttacctgcctgtcatcatgaaagcctgcggatgagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattcccaaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccagcaa

SEQ ID NO: 7531 - DNA, 5457 bp, Homo sapiens
gaaaaaaggcggaggtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacaggcctgccagtggtccccgagggctttgtttcaccccactggtggcacacagggccgaagaggctgccgatccctgctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccagcaa

SEQ ID NO: 7532 - DNA, 4102 bp, Homo sapiens
cggggccggggcggggccgagcgcggcgcagcggagcggggcagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgagcaggctacagtccactccagcatgaatgagatgctggaggaaggacatgagtatgcggtcatgctgtacacctggcgcagctgttcccgggccattcccaggtgaaatgcaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgcctcctttcacccaagaaccacaacgagacaaacctgccaacgtccagccttattacctctatggatccaagcctctcaacattgcctacagccacatctacagctcctacaggaatttcgtggggccacctcatttcaagactatgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatg

SEQ ID NO: 7533 - DNA, 6135 bp, Homo sapiens
atgaccacgcacgtcaccctggaagatgccctgtccaacgtggacctgcttgaagagcttcccctccccaacgagcagcccaaccgagtagagatctatgagaagacagtagaggtgctggagccggaggtcaccaagctcatgaagttcatgtattttcagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagttcctgcggaagatggcagatccccagtctatccaggagtcgcagaacctttccatgttcctggccaaccacaacaggatcacccagtgtctccaccagcaacttgaagtgatcccaggctatgaggagctgctggctgacattgtcaacatctgtgtggattactacgagaacaagatgtacctgactcccagtgagaaacatatgctcctcaaggtgatgggctttggcctctacctaatggatggaaatgtcagtaacatttacaaactggatgccaagaagagaattaatcttagcaaaattgataaattctttaagcagctgcaggtggtgccccttttcggcgacatgcagatagagctggccagatacattaagaccagtgctcactatgaagagaacaagtccaagtggacgtgcacccagagcagcatcagcccccagtacaatatctgcgagcagatggttcagatccgggatgaccacatccgcttcatctccgagctcgctcgctacagcaacagtgaggtggtgacgggctcagggctggacagccagaagtcagacgaggagtatcgcgagctcttcgacctagccctgcggggtctgcagcttctatccaagtggagcgcccacgtcatggaggtgtactcttggaagctggttcatcccacagacaagttctgcaacaaggactgtcctggcaccgcggaggaatatgagagagccacacgctacaattacaccagtgaggaaaaatttgccttcgttgaggtgatcgccatgatcaaaggcctgcaggtgctcatgggcaggatggagagcgtcttcaaccaggccatcaggaacaccatctacgcggcattgcaggacttcgcccaggtgacgctgcgtgagcccctgcggcaggcggtacggaagaagaagaatgtcctcatcagcgtcctacaggcaattcgaaagaccatctgtgactgggagggagggcgagagccccctaatgacccatgcttgagaggggagaaggaccccaaaggtggatttgatatcaaggtgccccggcgtgctgtggggccatccagcacacagctgtacatggtgcggaccatgcttgaatcactcattgcagacaaaagcggctccaagaagaccctgaggagcagcctggatggacccattgtcctcgccatagaggactttcacaaacagtccttcttcttcacacatctgctcaacatcagtgaagccctgcagcagtgttgtgacctctcccagctctggttccgagaattcttcctggagttaaccatgggccgacgaatccagttccccatcgagatgtccatgccctggattctaacggaccatatcctggaaaccaaagaaccttccatgatggagtatgtcctctaccctctggatctgtacaacgacagcgcctactatgctctgaccaagtttaaaaagcagttcctgtacgatgagatagaagctgaggtgaacctgtgttttgatcagtttgtctacaagctggcagaccagatctttgcttactacaaagccatggctggcagtgtcctgttggataaacgttttcgagctgagtgtaagaattatggcgtcatcattccgtatccaccgtccaatcgctatgaaacactgctgaagcagagacacgtccagctgttgggtagatcaattgacttgaacagactcattacccagcgcatctctgccgccatgtataaatccttggaccaagctatcagccgctttgagagtgaggacctgacctccattgtggagctggagtggctgctggagattaaccggctcacgcatcggctgctctgtaagcatatgacgctggacagcttcgatgccatgttccgagaggccaatcacaatgtgtccgccccctatggccgtatcaccctgcatgtcttctgggaactgaactttgactttctccccaactactgctacaatgggtccactaaccgttttgtgcggactgccattcctttcacccaagaaccacaacgagacaaacctgccaacgtccagccttattacctctatggatccaagcctctcaacattgcctacagccacatctacagctcctacaggaatttcgtggggccacctcatttcaagactatctgcagactcctgggttatcagggcatcgctgtggtcatggaggaactgctaaagattgtgaagagcttgctccaaggaaccattctccagtatgtgaaaacactgatagaggtgatgcccaagatatgccgcttgccccgacatgagtatggctccccagggatcctggagttcttccaccaccagctgaaggacatcattgagtacgcagagctcaaaacagacgtgttccagagcctgagggaagtgggcaatgccatcctcttctgcctcctcatagagcaagctctgtctcaggaggaggtctgcgatttgctccatgccgcacccttccaaaacatcttgcctagagtctacatcaaagagggggagcgcctggaggtccggatgaaacgtctggaagccaagtatgccccgctccacctggtccctctgatcgagcggctggggacccctcagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaatggcgtcatgcacgtcgatgagtgtgtggagttccaccggctgtggagcgccatgcagttcgtgtactgcatccctgtgggaaccaacgagttcacagctgagcagtgtttcggcgatggcttgaactgggctggttgctccatcattgtcctgctgggccagcagcgtcgctttgacctgttcgacttctgttaccacctgctaaaagtgcagaggcaggacgggaaggatgaaatcattaagaatgtgcccctgaagaagatggccgaccggatcaggaagtatcagatcttgaacaatgaggtttttgccatcctgaacaaatacatgaagtccgtggagacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatgaaaaaaaaaaaaaaaaagtaaacagggcagtgtgtgctttttcttttctcccccctcaactatattaagaactcctagtttcaccctttctccatcccatcatcccacctatctgtggttgcttcccaagacctcctcccaagatagacatctcctacccagtgcccttgtgtgaccccaggactcaagtctcagactgtgaacagatgtggccatgcccagagacgccagcctggccagaagggcatgcctcagcttactacttcatctctcctggttccctccctgcagtgccccgggtgtcatcttctcccactctgggtaccagggattctaccacataggcttcccaaagccccattctaactcccctctctcagggaagccctagagagaggtccaaaaagcattcacagctgtatcacactctatgcaggtggggtaggagactgatcaggcctgctgtggggaagcagtatgtatgaacacagccagaaatgtcatagtccaaacaggatgctttcaggccatctcagctgcttgatggtgagatggttcccttattccttcaggaaaggcttagcattgggccacataggggaagcagctttgaacaaatcagtcatagcactgcctatagcattagccagtgaccaaattagggacaacgtcttggcacagaattgcttatcaaggaacatttccacaagaaagaaaatattaaggggttatttccacagaagcccaaaacgtcttggaaacacagaggtgaggaggaggaatagtaattgtcaatgagcttttaataccaagatacaccccctgcccccaaagaagagtcctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttccctggcttgccagtggcactgatttccgaacacccaatgagtttaatattctttcctccttggcattactgccccagcctctttttattttttttgtgtgtgtctaataaccaggaaaaaaataaagcttaggttttaaaaagttttaaaaataatctgtttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactagtaaaaccagcaa

SEQ ID NO: 7534 - DNA, 8090 bp, Homo sapiens
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattc

SEQ ID NO: 7535 - DNA, 7910 bp, Homo sapiens
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagatggtactaccactaaagcggagggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaaggttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattc

SEQ ID NO: 7536 - DNA, 5135 bp, Homo sapiens
gctctctatggtgtacccgggttggtggcggtaagaagaaaaagggtgaccgcactgcgcaggcgccctcggcgtctctctcgctctctcggtcttttttttttttttctttttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagttagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaa

SEQ ID NO: 7537 - DNA, 3967 bp, Homo sapiens
ttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagattgctgattcagaagcagaatgtgaggataaagaaggaaatttgtttccatcagaagtctcttgtacagtgagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtccctt

SEQ ID NO: 7538 - DNA, 7958 bp, Homo sapiens
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttggtaagaggcacaagcacaggaaaaaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagattgctgattcagaagcagaatgtgaggataaagaaggaaatttgtttccatcagaagtctcttgtacaagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattc

SEQ ID NO: 7539 - DNA, 7907 bp, Homo sapiens
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagagtccagacacatgagggaagacatggagtacataggcctggactcaggtcggatccgcacaagacggcaaagctctgggagtgccaccaacgtcgcctctacacctgataaccggggccgcagtcgcgctaaagtggtttcacagtcccagcctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattc

SEQ ID NO: 7540 - DNA, 6851 bp, Homo sapiens
atgttgcagaattgttcagataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagattgctgattcagaagcagaatgtgaggataaagaaggaaatttgtttccatcagaagtctcttgtacaagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattc

SEQ ID NO: 7541 - DNA, 3942 bp, Homo sapiens
agagcagtgtttttatttggtaccaggattactgacaatcatgactactgggaaagataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttagatggtactaccactaaagcggagggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagatcggtttgggcttggccagccaggaagaatacctggttctgtgaatgccatgagagttctgagcacaagtacagatcttgaagctgctgttgctgatgctttgctgttaggagactccaggagcaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaaggttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactg

SEQ ID NO: 7542 - DNA, 7257 bp, Homo sapiens
agaggtcctatcgctcccagcggtttccgcagccacctccaccacctccgcagcaaaacgctagccggactggagggccctcgccggcgtcgtgctgacgtcacgcgcgtgctgacgtcgcccgcggccgcggcctctgaagcgggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgt

SEQ ID NO: 7543 - DNA, 1597 bp, Homo sapiens
acagcacctagggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaatgtgaagccttttggagatctgggagaactgcaaagctctactctgtctaaccaaaccctaaacatatattccaaaactctattcagtttgatttcttcatgtttttatgtctatcaaattaaaaagttgacgttggtttgcgtatctcttcttcatgcttccatttttttcttt

SEQ ID NO: 7544 - DNA, 7254 bp, Homo sapiens
agaggtcctatcgctcccagcggtttccgcagccacctccaccacctccgcagcaaaacgctagccggactggagggccctcgccggcgtcgtgctgacgtcacgcgcgtgctgacgtcgcccgcggccgcggcctctgaagcgggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgt

SEQ ID NO: 7545 - DNA, 7282 bp, Homo sapiens
agaggtcctatcgctcccagcggtttccgcagccacctccaccacctccgcagcaaaacgctagccggactggagggccctcgccggcgtcgtgctgacgtcacgcgcgtgctgacgtcgcccgcggccgcggcctctgaagcgggctggggatcggggggcgccgagtttgactagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaa

SEQ ID NO: 7546 - DNA, 6978 bp, Homo sapiens
gaaagttggccgctcacagactggcaggcgggcgggcggccgcagccatggagccccgcagcatggagtacttctgcgcccaggtgcagcagaaggacgtcggcggccggctgcaggtcggccaggagctcctgctctaccttggcgcccccggcgccatctcggacctggaggaggacctgggccgcctaggcaagacagtcgacgcgctcaccggctgggtgggttcgagcaactaccgggtatcattaatgggattggaaattttaagtgcctttgtggacagattatcaacacgctttaaatcctatgtagcaatggttattgtagctttaatagacagaatgggagatgccaaagacaaggttcgagatgaagctcagactctgatattgaagttaatggatcaagtagcaccacctatgtacatttgggagcagttggcttctggttttaaacacaagaattttcgatctcgagaaggcgtgtgtctgtgtcttattgaaaccttaaacatttttggggctcagccactagtcatcagcaaattgataccacatttgtgtatcctgtttggagactccaacagtcaggtgagagatgctgcaatattggctatagtggagatttatagacatgtgggagaaaaagtgaggatggatctttataagagaggaattccccctgctagattagaaatgatatttgccaaatttgatgaagtgcaaagttcaggcggtatgattttgagtgtctgcaaagataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagcaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgctcttaggagacatacggactaagaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaa

SEQ ID NO: 7547 - DNA, 5972 bp, Homo sapiens
attgctactgattacatggatatctttagggaagcagaaaatgattgctgaacacatgccttgtgttttgatgattgcattaaaagtcccccagcgggatggcatttattggctctcagagcttttcttagattaaatttcaggcagccagtacaaggagaaacatcataacctgtatccaacagcatatgtgcagctaaagagtaatcttaatcaagtccttctaggctgtgctaaataaacgagggttttcagcaagaccccagacttttattttgaagtggagtagcagctgttggctattgcggtgcagagctgcagcgaggcctgggtcacacagtgctccgggtgtctgcaggctgcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtt

SEQ ID NO: 7548 - DNA, 6234 bp, Homo sapiens
atgaggcgactgatttgcaaacggatctgtgattataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggagaattattgtctataatgatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagcgggcgcttaggtgcaggtgccctgaatgcaggttcctatgcgtcactagaggatacttctgacaagctggatgacttatttagtgataatggccgggtgagagcaaaactttcagcaccacttgctggcatgggaaatgccaaggcagattctagaggaagaagtcgaacaaaaatggtgtctcaatcacagcgttcatcatcacctgacaaaaatgaaggatcacaatctgctaataccattggtgctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttggtactctttgattttaaaacaaaaaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaaggtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgt

SEQ ID NO: 7549 - DNA, 2013 bp, Homo sapiens
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttc

SEQ ID NO: 7550 - DNA, 5504 bp, Homo sapiens
atgccgccgcccagccccgactcagagaacggcttctaccccgggctgccgtcgtccatgaacccggccttcttccctagcttctcgcccgtgtcgccgcacggctgcactgggctcagcgttccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 7551 - DNA, 5524 bp, Homo sapiens
ctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggca

SEQ ID NO: 7552 - DNA, 5509 bp, Homo sapiens
ctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtaagaatggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggca

SEQ ID NO: 7553 - DNA, 6797 bp, Homo sapiens
atgagggatttcgggtttggggtgctgcagaccgccccgctccgaagtagcagtcctgggcccctgttctgcggcgaggcgtatggtccttacgccgtggggtccgtcaacccgctgccctccgccacgcccttcggcccactgtcgccaccaccgttgcctgtcaccggcttcttagaggccgcctcccccttctccgtccccctcggcggcggcgcgggcagcccggccgccgccgcttcctcttcctccccgttcctggcgcatcagcagaccatgcaggatgagctgcttctggggctgacacagcagccggcgcggccgctttcgggggcggcggccacggagaaactccccgaccaccaccccggcggcggcacgatcgcgggtgtgacccacctcctcccctcccaggacttcaaaccgagtctgcaccacccctcctcctcctccgcctcctcctgctgctgctgccgcacctcctccccgcaggacttcagtaagcggcagcagcagcagctgagcagccagaagaggaaagagttcagccctccccaccttccccaccctccggactcgaagccgccgccgccgcctccgccgctccactgccccggtcggttcagcccgccgccgccgccagccggcccgctcctccagccggcgcagctcgctcagcgccagcagcaacagccgccgcagcagttcagcctcctgcatcagcagcacctctcgccgcaggacttcgccccgcggcagcgtccggcagacctgcccccgctcccgcagctccctccctcgccgcctgcagccccgcggcgccgccacggaggcgcgggcagccctcgcaagaccccagccgcgggcgagggcagcgccgccgagtcccccaatgcgggcttggcctcctcgacgccggtgaaccccgcgccgggctccatggagtcccccaaccaccctctgctcaacagtcccagtaacctcctgcccggaggtgcgcttggcgcgggcgccttcagcagcctgcagagcccggaccttccacacccgggcggcggcggcggcggcgggggcggggggcccccaggaggcggagggggaggcggctccgcgtcgccgccgccgctgcccggcttcggcaccccctggtcggtgcagaccgcgtcgccgccaccccagccccagcagccgccgccgacccagccgcagcagcagccgccgccaccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtaagaatggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 7554 - DNA, 2103 bp, Homo sapiens
ccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttc

SEQ ID NO: 7555 - DNA, 6878 bp, Homo sapiens
atgagggatttcgggtttggggtgctgcagaccgccccgctccgaagtagcagtcctgggcccctgttctgcggcgaggcgtatggtccttacgccgtggggtccgtcaacccgctgccctccgccacgcccttcggcccactgtcgccaccaccgttgcctgtcaccggcttcttagaggccgcctcccccttctccgtccccctcggcggcggcgcgggcagcccggccgccgccgcttcctcttcctccccgttcctggcgcatcagcagaccatgcaggatgagctgcttctggggctgacacagcagccggcgcggccgctttcgggggcggcggccacggagaaactccccgaccaccaccccggcggcggcacgatcgcgggtgtgacccacctcctcccctcccaggacttcaaaccgagtctgcaccacccctcctcctcctccgcctcctcctgctgctgctgccgcacctcctccccgcaggacttcagtaagcggcagcagcagcagctgagcagccagaagaggaaagagttcagccctccccaccttccccaccctccggactcgaagccgccgccgccgcctccgccgctccactgccccggtcggttcagcccgccgccgccgccagccggcccgctcctccagccggcgcagctcgctcagcgccagcagcaacagccgccgcagcagttcagcctcctgcatcagcagcacctctcgccgcaggacttcgccccgcggcagcgtccggcagacctgcccccgctcccgcagctccctccctcgccgcctgcagccccgcggcgccgccacggaggcgcgggcagccctcgcaagaccccagccgcgggcgagggcagcgccgccgagtcccccaatgcgggcttggcctcctcgacgccggtgaaccccgcgccgggctccatggagtcccccaaccaccctctgctcaacagtcccagtaacctcctgcccggaggtgcgcttggcgcgggcgccttcagcagcctgcagagcccggaccttccacacccgggcggcggcggcggcggcgggggcggggggcccccaggaggcggagggggaggcggctccgcgtcgccgccgccgctgcccggcttcggcaccccctggtcggtgcagaccgcgtcgccgccaccccagccccagcagccgccgccgacccagccgcagcagcagccgccgccaccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatgcaaggagttatgggcgaagacgaggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 7556 - DNA, 6854 bp, Homo sapiens
atgagggatttcgggtttggggtgctgcagaccgccccgctccgaagtagcagtcctgggcccctgttctgcggcgaggcgtatggtccttacgccgtggggtccgtcaacccgctgccctccgccacgcccttcggcccactgtcgccaccaccgttgcctgtcaccggcttcttagaggccgcctcccccttctccgtccccctcggcggcggcgcgggcagcccggccgccgccgcttcctcttcctccccgttcctggcgcatcagcagaccatgcaggatgagctgcttctggggctgacacagcagccggcgcggccgctttcgggggcggcggccacggagaaactccccgaccaccaccccggcggcggcacgatcgcgggtgtgacccacctcctcccctcccaggacttcaaaccgagtctgcaccacccctcctcctcctccgcctcctcctgctgctgctgccgcacctcctccccgcaggacttcagtaagcggcagcagcagcagctgagcagccagaagaggaaagagttcagccctccccaccttccccaccctccggactcgaagccgccgccgccgcctccgccgctccactgccccggtcggttcagcccgccgccgccgccagccggcccgctcctccagccggcgcagctcgctcagcgccagcagcaacagccgccgcagcagttcagcctcctgcatcagcagcacctctcgccgcaggacttcgccccgcggcagcgtccggcagacctgcccccgctcccgcagctccctccctcgccgcctgcagccccgcggcgccgccacggaggcgcgggcagccctcgcaagaccccagccgcgggcgagggcagcgccgccgagtcccccaatgcgggcttggcctcctcgacgccggtgaaccccgcgccgggctccatggagtcccccaaccaccctctgctcaacagtcccagtaacctcctgcccggaggtgcgcttggcgcgggcgccttcagcagcctgcagagcccggaccttccacacccgggcggcggcggcggcggcgggggcggggggcccccaggaggcggagggggaggcggctccgcgtcgccgccgccgctgcccggcttcggcaccccctggtcggtgcagaccgcgtcgccgccaccccagccccagcagccgccgccgacccagccgcagcagcagccgccgccaccccagcagccgccccagccgcagccgcagccgcccggctcgtctgccaccaccccgggcggcggcagcggcggctcgctcagcgccatgccgccgcccagccccgactcagagaacggcttctaccccgggctgccgtcgtccatgaacccggccttcttccctagcttctcgcccgtgtcgccgcacggctgcactgggctcagcgttccgacgagcggcggcggcggcggcggcttcggcggccccttctcggctaccgctgtgccccctccgccgccgcccgccatgaatatacctcaacagcagcccccgccgcccgcggcgccgcagcagccgcagagccggaggtcgcccgtcagcccgcagctccagcagcagcaccaggcggcggccgccgccttcctgcagcagaggaactcctataaccaccaccagcctcttctgaaacagtctccctggagcaaccatcagagcagtggctggggcactggaagtatgtcctggggagcaatgcatggcagagatcatcgtagaaccggaaacatgggaatcccaggaactatgaatcagatatctccattgaagaaaccgttttctggtaatgtcatagcaccaccgaaatttactcgctcaactccatcactgactccaaaatcttggattgaagataatgtgttcagaacagacaacaatagtaatacactcttacccttacaggtgagatctagtttgcagttgccagcttggggctcagattcactccaagatagttggtgcactgcagccggaacatccagaatagaccaggatcgaagtagaatgtatgacagtttgaatatgcactctttggaaaattcccttatcgatattatgagagcagagcatgatcctcttaagggtcgattgagctatccacatccaggaactgacaatctgttgatgttaaatggtcgttcttccctctttccaatagatgatggcttgcttgatgatggtcacagtgatcaagttggagttttaaattcacccacctgttattcagctcaccaaaatggagagcgaatagaacgcttctctcgaaaagtttttgttggtggtcttcctccagatattgatgaagatgaaataactgctagcttcagaagatttgggcctttggtagtagattggcctcataaagcagaaagcaagtcctattttccaccaaaaggctatgcatttcttctctttcaagaagagagctcagttcaggcactcattgatgcttgtattgaagaagatggaaaactctatctgtgtgtttctagccctactatcaaggacaaaccagttcaaatacgtccttggaatttaagtgatagtgattttgtaatggatggttctcagcctttggatccccgaaaaacaatttttgttggaggtgttcctaggccattaagggctgtggaacttgctatgatcatggaccggctgtatggtggagtttgttatgcaggaattgatacagatcctgagctaaaatacccaaaaggtgctgggcgagttgctttctccaatcagcagagctatattgctgccattagtgctcggtttgttcagcttcagcatggtgatattgataaacgtgtggaggtaaagccatatgtgctagatgaccagatgtgtgatgaatgccagggcgcacgctgtggtggaaaatttgctccctttttttgtgccaatgtcacttgcctgcagtattactgtgagttttgttgggcaaatatccactctcgtgctggacgtgagttccataagccattggtaaaggaaggtgctgatcgcccacgtcagatccacttccgctggaactaagaatagcaaactggcctctgtttaacaaggaaagaaagggtgcatgtggcttactgtgtctgaagatactgacatgcagaagaaataagtgcattcttctgcttttcaccccagctatcaatacatgcatctttatcagcagccaaaacactacaagcctcttgtttttcaccaaaaccctacatctcaggcttactaatttttgtgatattttcatgttcaaataaaatgtttttttgtattttctccaagttatttttatatgtaaagttaaaattagatatgagaatgttttgcgtaggggcaacacagtctgctgctatatagtgggggaagcgtgcacttatttctaaacatgggtttttaacttcaagatctgccccagtaatttaccaaaggtagcaaaataatagtgaagatggaatatgtctgctacaaatgcttatttttattgttgctattttcagtgtatacataaactaaaaattagggttgatttttttgctctccattttgacttgcaagaaataatacctcaagataatctgatttattagctatttttaaacatttttaatcacaagctgtattagctttgctgctatataggtgttatgtgtaaatgccacctattaatacgggactgaaaacgttagagacacactgcattgcagataaaatgcaggcagcacaatatggcctaaactgccatagttttagaatgtgaaaaaaatgcatgtttacttacctgtatacaccatatgcatgcactagaattattaactaacgaggtgaggtattgcaaatgttcaaaaaagctctcttgaatctaggtagcatgaacaaattataaaatttgtttaaaaaagcaaacttgcatgcattattgtgacttcaagtttaaaaaatcgtcttacatgtgtacaatatgcaaattagttttagattagagagtgcagccattttgtgatctggtcagtagtggaattcgattttatgcagactggatgtaatatttgtaatccctgtgcaattttgtgacgtgcggttctaattcatgtgcagtgatatagtatagataaaagaatgagtaaaagaaaatacaagaattctaaagaaagttggttttagcccctttgatagtccatggttaagacatcctttataaaccaaagatggccagcacactgctaaccagtcaccaaatgtaagacccataagaaacccatatttaaaaatctgaattttttagaagaatgcaaaactttagtaaaccctaagtaaagtcaaaatggagaaggggaaatatacagatggctagttgcataaaattaaattttacctttataagacaatggtgaaatctggcttgaacttgcttatgtgtttaacctataaatattggggtcttctgtctaaactggggtcactgttgcatggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcata

SEQ ID NO: 7557 - DNA, 4851 bp, Homo sapiens
gtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggtaaacactaccctcccagtggcccaccaatgagtttcgctgatataatgtggaggaatcattttgcaggacgcatggggataaatttccatcatccaggaacagataatattatggcacttaacaatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtatggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaa

SEQ ID NO: 7558 - DNA, 5876 bp, Homo sapiens
gtctccactagaggctgcacagcccgcccggaccaacgcctccgcgcctgccgccgtctggccggcgccctcccgtttccttcctccagggggaaaaaatgtctttcgggccgctttccaggaagcagcaggatgcgccgctccactgtcggtagcaacaagcataatcaacctgaaagaagaaaataaatactgtatacttttaaattttatcgattcttaaaaactggacactcaaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggacgcatggggataaatttccatcatccaggaacagataatattatggcacttaacagtcgatcttctctctttccctttgaagatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtatggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagcag

SEQ ID NO: 7559 - DNA, 5745 bp, Homo sapiens
acagttgtcaaagtgcttttgccagagcggtcacataatcaacctgaaagaagaaaataaatactgtatacttttaaattttatcgattcttaaaaactggacactcaaagctgcgcaaaccatgcaggatgatttactgatggacaaaagcaaaacccagccccagccccagcagcagcagcggcagcagcagcagccccaacctgagtccagcgtatccgaagccccgtccacgcccctctcctcagagacccccaagccggaggaaaacagcgcagtgccggccctcagcccagccgctgcccccccggcccccaacggcccggacaagatgcagatggaatcaccgctcctgccaggcttgagtttccatcagcctcctcagcagccgccgccgcctcaggagcccgcggcaccgggcgcgtcgctgtcgccgtccttcggcagcacctggtccacgggcaccaccaacgcggtagaggacagcttcttccaggggatcaccccagtcaacgggaccatgctcttccagaacttcccgcaccatgtcaacccagtcttcggaggcactttctccccgcagatcggcctggcgcagacccagcaccaccagcagccgccgccgcctgcgcccgcgccgcagccggcacagccagcgcagccaccacaggcgcagcccccgcagcagcgccgctcacccgccagccccagccaggcgccctacgcgcagaggagcgccgccgcggcgtacggccaccagcccatcatgaccagcaagccgtcctcgtcttcggcggttgcagccgctgctgccgcagccgccgcctcgtcggcctcgtccagctggaacacgcaccaaagcgtgaatgcagcctggagcgcaccgtccaacccctggggcggcctgcaggcgggccgggaccctcgccgggcggtcggtgtgggcgtgggtgtgggtgtcggggtgccttccccgctcaaccccatctcgccgctcaaaaagcccttctccagcaacgtgatcgcgccgcccaagttccctcgcgcggcccctctcacttccaagtcctggatggaggataacgctttccggaccgataatggtaacaatctgttgccatttcaggaccggagtaggccctatgatacttttaacttgcactcgttggagaactccttaatggatatgataaggactgatcatgaacctctgaaaggacgcatggggataaatttccatcatccaggaacagataatattatggcacttaacagtcgatcttctctctttccctttgaagatgccttcctggatgatagccatggtgatcaagccttgtcatctggcttaagttctcccactcgctgtcaaaatggggaacgagtagaacgctactctagaaaggtgtttgttggaggacttcctcctgatattgatgaagatgagatcactgccagctttcgcaggtttggacctctcgtagtagactggcctcacaaagctgaaagcaagtcttattttcctcctaaaggctatgcctttctgctgttccaagaggaaagctcagtacaagctttgatagatgcctgcctagaagaagatgggaaactctacctgtgtgtgtcaagccccaccatcaaggacaagccagtgcaaattcgaccatggaacctaagtgacagtgactttgtaatggatggttctcagcctttggaccccagaaaaactatctttgttgggggagttccacgaccccttcgagctgttgaactggcaatgatcatggaccgtttgtatggtggtgtctgctatgctggcattgatacggacccagagctgaagtaccccaaaggtgctggccgcgtggcattctccaatcagcagagttacattgcagccatcagcgctcgttttgtgcagcttcagcacaatgacattgacaaacgggttgaagtaaagccatatgtgctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtggaaggtcactatttctgactgcatgtttacttaatcaggttgctgcatgcaataaattttatatccaatgtctagtataaaacgttcccacaatgcacaaattaagaatctatataagctataaaaatactcattttttaaaaaaagtttttttcattcaaagaattggtaattgaccggaggaaggcatgcctcaataaatggaatgctctgaatgggaagagcccataacagaatgacctatattacaaccgatataaaacctaggtgtaggatattcttcaagcaaatttgtggatggtagatgaagtactttgcggtgctctgttatatattgtgaaatttattttatatagtaaagtgattatgtctaactgtgatcaaacttaactgtttaaagcctctgtcagacattaatgaacttgacagttcataactgatatattataaactaacacatgagctcttagttacaatctcttagtgcttgcaccattttacatagcttcagaccttgtccagaaaaccaaagagctcatcttagcttacaaacactaagaatatatacaggatatagagataagttgtcagattgacaaactaggcacatttttaagaaagttgtgtaatggtgatgctaaagaaatgtctgtacaaaataagatggcctgggcagagttggttgtctgagtgagaaactaactacttaattccctggatttatcctgttaagcttgagtagaatgaaggcctgctagcactagcgtggtctagaatgaaggcctgctagcactagcgtggacatttttctagcattcacccttgggctgcagatagtaatatataaacacacacaatgattgcaagactatgtaaatctttttttaatcttcttcctatgttttggaattctggggacaatctgactggatatgacactgcagaatagatttaagtcgctgtgttttctgtgctgtgatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattttttgctaagaaaaaaattaaacatatttacatatttttcattttatttcgtattttctttaaggagtgctttctcaatcattaatagagttgtttctgggagggactttcatatctggtcaatgtcataatattattttgtatttttattggaataaattaattttatgatgctaattctttaaaagtttatttttttcattttcagttatttttgaagctaaaacctttgtaatattgttactaaagtgtctagttttttgaaatgcaaagctttatgtattaacttgctgatgtggtttacaatagtgtgacaacgatgaaaatgcttggttatgtaaagtgattggaaatgtaatggataattgggtaataaaatgacagaatgagc

SEQ ID NO: 7560 - DNA, 9483 bp, Homo sapiens
agtgctacccccacccctccctcttcgaaccggaagtgtctctgggtctttccagctggttgtcatttcactcggctcggtcctgaggagaaggactcagccgcggctgcgggacccgggcaccgggaggcggtggcggcggcggcggcggcagcagcggcgacagcagaggaggaagaggaggaagaaggaaagaaaaagaagaaccaggaggagtcctcaacaacgacagcggggactgcgggaccagggtaaagcggcgacggcggcgacggcccagcaaccgtgaggagaaacaaaagccttctaaattatagtttaaaaaaaaattctgggggaaaagagagagaaagccgaggggggaggcccttctcctttaaaataactacggtagtgggtttttcctttttttcctcttttttccctctctgcggagaatcgaactgagggaactgaacaaaccgcccctgggtcccatgagggaaaaaaaccccggagccgcagagaggggaagaggcagaaaccgcaggaccttccaggtcgccccctcggtccccgcacccccaggccgcccgctcaccctcgtcgagtctcgctaatccctcctgatcgcgacccccgcaagagggagaaacgggtgtttccaacccctttcatgggggagaggaagccgcggggagcccaggaacagcgaccgcagcaagatctgcacccggagcctcaggaacagccccagaggccaaaactgcaccctgcgaaagagcagaaaacaggaccaggaacagcagaaacctccctgcaatcatctttccattagtcaatgctgatttcctctcccgaaaccaggaattcacttcccaccccagataacctaatataatctatatatataaatatataatatataatgttcttaaattattcctgatttttttttaaccaagctgccaagaaaagaacgtattcccctcttagtcctattctaatttttatgtgagtgaatctaaactgctgaggaaaaccatatgtgattgttaaattatatatatctatatttttactccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatgcaaggacatatgggcgaaggagaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactcagatttcttttaatatacttatttctttttaacacaagtagatgatgctttcttgactgggaatgtaacattttaaaatattaggaatatactgttcagctaatgcagcacaaaccaataggaaaaaatcttcagtcatataagtactgtggccagtgtgcattcttatgtaagcctataagcgtcggtgggtggttgtgtctttggcctgtactgttagttcacctgctgcctgccctgcagagttctttttatttgtagccttcaatatgtatacagggagtaagcccaggatctaagcattcagttatcagttgaaggccaaatgcccaacaaaagtgaaaaacccaatgtttagttaataatgaaagtccgtatctgggaggttcagttttgagtctttgtcaatgaatagtcttgatttgtggccacactaccaaagggcttgaaaacaagtctcttttgacttccaattcccagttcctccatagaccttaatgtcataggatacggtgtgtgggattataatctctatggcatgtcaattgaaaatattatctttgatttgatccattaatcatgtggactaccaagtgctgtaatgtgttagtatttatattttaaactgcattctcaaacttttaacataaggatttattataacaaaatataacactgagaatatcctgttttgtcagatttaatatctgttctttcttgagtatagtattctcaagactagaagaggttcttgtcctgagagaaatggactatgagatcttttgcgtctaagttgtctttcccaacaggcagctcttctaactatagagattactgagggtaagggcaggctggacagcttcccctttctctcatctggcaattcccaaaccttacgttgagcattcaatgaagggccttgaggaaaccccagggatgggacactggagatgtgggtggcatttggttatcaagtctataatattcctaggcattctgggatggtttcactattttaagaaaagaaaaaaaagatagcccaagcatatttagtttattttaggaaatgtttatttcaggtaagtgagatatcaatgatatgtgatataacaactctatcttgaaattacataggtgcattgctttgggtgttttaaatcacagaatggtgtgtctggaaagggtgtaagaggcttcctgggctatatttcttcattcactgattgcctaaacctacccaacgaggaaaattctttttatttttatcttttgtttttactgtctaaccagatgaataaacagtggaaattctctaccacactcttaacaatcaagtcatttcataaccccttttggtaatgggtgtttgtgtccacagctagatcagaaagtaagtactttttctagggatttttttttttttttaagtttgggaaatagtttgatcaaaagtcatggggaaagtaatctctgattttaaaaattgaagaatactgaaggtgtcagtgagttagaaatttttaaggagtaattattttctgaaatgtgtaataaccgaataataaacaagacaaaactctaatatttcagactgtgatcttcagaggactaggatagtcctttccacaagaaaaagacaaaaaaaaataaagttttaccattaaataca

SEQ ID NO: 7561 - DNA, 6705 bp, Homo sapiens
ctccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaagcaaggacatatgggcgaaggagaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactcag

SEQ ID NO: 7562 - DNA, 3375 bp, Homo sapiens
ggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaatt

SEQ ID NO: 7563 - DNA, 1939 bp, Homo sapiens
ggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcaggtaagataaaaatttactgatctttacaattacagtgtagtagacaattcggaattaatttgaaacacatcacaacataacttgagaaaattttctttgtatatgtagtggtaataaatgtttaaaggctgcaaggattgcattataaaagctgtttgttggctttctaagtcttttattcctgtattgggaataatcagattttagaaaatggatataagctgaaatgtatatttaatgaaactttctgcatgaaatgttttagcatattattgtatgcatttcctggttggaagtttactgggagactgaatgtaatattaaaatttgtttattgaatataaa

SEQ ID NO: 7564 - DNA, 3351 bp, Homo sapiens
ttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaatta

SEQ ID NO: 7565 - DNA, 1682 bp, Homo sapiens
accggccccggcaactgcagtccaggctccgcctccctacgcccattggcttattcaattcacgcaggaaccaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcatatt

SEQ ID NO: 7566 - DNA, 6516 bp, Homo sapiens
actgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctg

SEQ ID NO: 7567 - DNA, 6428 bp, Homo sapiens
aattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactata

SEQ ID NO: 7568 - DNA, 6692 bp, Homo sapiens
actgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaaccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctg

SEQ ID NO: 7569 - DNA, 6717 bp, Homo sapiens
actgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctg

SEQ ID NO: 7570 - DNA, 582 bp, Homo sapiens
aatgctgctgccgccgccgccgccgcctgccgggtattcctgctgatcctgctcggaccttagcttccctgacctctccctgcccggggagcgaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagcc

SEQ ID NO: 7571 - DNA, 7121 bp, Homo sapiens
cccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaagg

SEQ ID NO: 7572 - DNA, 1533 bp, Homo sapiens
ccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactata

SEQ ID NO: 7573 - DNA, 2469 bp, Homo sapiens
agaatctagaggaagttgacaaaggtgccacagcagcacagcacagtatgtggtggagagttctcagcttgctggcatggttccccttgcaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataa

SEQ ID NO: 7574 - DNA, 1929 bp, Homo sapiens
aaaaaccagagcaggagccacagaacacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaat

SEQ ID NO: 7575 - DNA, 525 bp, Homo sapiens
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtga

SEQ ID NO: 7576 - DNA, 1977 bp, Homo sapiens
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 7577 - DNA, 969 bp, Homo sapiens
tctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcacaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgaga

SEQ ID NO: 7578 - DNA, 266 bp, Homo sapiens
tgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagtgcccccaacagagccagaatgtgaaaagcaatttcagccttattttattcccatcaattga

SEQ ID NO: 7579 - DNA, 1640 bp, Homo sapiens
cgcgcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaagcgagcctcccccctcccttgcgggggcggggagggttctctgtgtgtgtccccggcacgtcagggaccctatcctcccaccgcctccgttaacacgatcctgaataaatcttgagaacccc

SEQ ID NO: 7580 - DNA, 2617 bp, Homo sapiens
ttcggccgctgggcggagccgtcaatgcgcaggcgcggcgtcgccccgcccactccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaa

SEQ ID NO: 7581 - DNA, 1118 bp, Homo sapiens
actccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcgtcacctgtgtgccgcccgcctgtggtcctgggagcccgaggccagcccggctgccgcatcctgctcttcgcactccaggtgtctgcccccagcctctgcgcctgtga

SEQ ID NO: 7582 - DNA, 2208 bp, Homo sapiens
aatgcgcaggcgcggcgtcgccccgcccactccggctcggcggctctgggcctgcggcgggcgctgcgggttggagctcgggacgtgatcgtgggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 7583 - DNA, 1312 bp, Homo sapiens
ttcggccgctgggcggagccgtcaatgcgcaggcgcggcgtcgccccgcccactccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcgtcacctgtgtgccgcccgcctgtggtcctgggagcccgaggccagcccggctgccgcatcctgctcttcgcactccaggtctcagacaggagtcactcgcctcttcgtgccacgcccacgtctaagccgggtggaacaggccctgtgaggatggtcctggtgtccctcgtgctcgtgggctcggtccagctctccagggccccagtcagccctggctcctgctctcctgcagctggggcgacttccgacg

SEQ ID NO: 7584 - DNA, 2227 bp, Homo sapiens
ttggcgaggctctgggcaggtcctgaggcttttctctgctgttgtccggtgttggcgaggctctgggcaggtcctgagccattctgctttccactctgtggtctttcccttctgggagccctgggtttttggacatgttgagacaatggggcttgcgcaggtccagccgctgccgcgggggccctgtgttcaacgggggacactcagccctgcccaggccccgctgtagcctcagcccacccgagtggaagccacactggtcgcaccagatgccccgggctcctctgagtagtgaccacggcgggtctcattggcactgcctatccacccgtcacgtgtccttccctcccccgtggcccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 7585 - DNA, 2294 bp, Homo sapiens
ggccggattcccagtggtggcgaggaggtggtatttttttaagtgtcagtgtggcattgtggttgcctcaataaaacagagtctttttttgtcttttttttttgagacagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 7586 - DNA, 2868 bp, Homo sapiens
ggtgagctgggagactttctttccatttcttcttttctttgttttcccatgttgctttctgtaagcacgtttttcttttatgctgggaaaaaagccaataattttttgttgttgggggatggagtttcgcactgtggcccaggctggagtgcaatgtcacgatcttggctcactgcagcctccacctcccggattcaaaccattctcctgcctcagcagcctccacctcccgggttcaaacgattcttctgcctcagcagcttccacctcccgggttcaaacaattctcctgcctcagcctcctgagtagctgggattacgggcacctgccaccacactcagctaatttttgtatttttagtacagacagggttttgccgtgttgtccaggctggtctcgaactcgtgacctcaggtgatccacccacctcagcctcccaaagtgctgggattacaggtgtgagccactgtgcccggccaaagacgactttttaaaccttctgaaagtcagcttaaccagagagctgtgtgctccgcaggctgcctgggtccttcttggccacgaaagatcagtggttgctattacagctgttctgcccgagcagccctgattcttgccctggcagccggagcctctgctcactctgccttccttgctcacttctagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaaggtgccctgtgtcctgcttgcaggtccccgctctctgtccgtccagtccagccttgtcttgggatgcctggaacggtcattggtgcagcctagacagtgtgggatgtggctgaaatgtgactgggtttcatggctttgagagagtagcctctttggatggaaaatgtattcctggtgtctaggccattttcattaatatttaaaaagtacttcctccccaccatgaccctccccaaccccatgctgtgggatgagcaaggggactgccccattgctggtcccctgcagcctgtggttaagcggccagtcagcggcagctccgcatagagtcgtgtggaaggagtggaggcaggaggagcccctggggctgtggaggcttagcctggacctcgggagtcctaggatgggcagttttccttccctaggaggaaggggcgttgactgtgtgaccagatgatttggccttttgaggccaaaggaaggaggggcaaggcctgggcagggggagccctcggtcaccgtcaccggggcctgggcagggggagccctcggtcaccgtcaccggggcctgggcagggggagccctcggtcaccgtcaccggggcctggatagtgggagccattggtcactgttaccgggacctgggtgggaggagccctcagttaccttcaccggggcctgggcagtgggaggcgcccttggtcaccgtcaccagggcctgagcagtgggcgcaggactttactcccgcttagttgatttcaggctcgtgttagcctgggtgttgcccttgccatcttcccccctcacctctgcctgccattcctgcatcagcctcccaaagctctgggaatacaggcgtgagccactgcgcccggccaagtgtttctcttagaatttcctgaaatgatagggtctctggaggggcaggtgctgggcttgagccctgggtaggaccctgcaggggagaggtggtcctgcagcccacagaggatggctctgtcctgttcctcatggtgcagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 7587 - DNA, 1632 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaa

SEQ ID NO: 7588 - DNA, 3229 bp, Homo sapiens
acattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagc

SEQ ID NO: 7589 - DNA, 2303 bp, Homo sapiens
gcggcagagcgggcggcgcaggccgggctgggcccgcgcgcggcggcagcggcgccccgggccggaggcggcccagccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgccca

SEQ ID NO: 7590 - DNA, 2227 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacga

SEQ ID NO: 7591 - DNA, 1084 bp, Homo sapiens
gaatgaaatcgtagcgcgctgggcggcagagcgggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatagtgagtccttctgaagagggggaaaggcagagagaggggtgcccagagactccccacctcgtggccctctccctcccgttccagacccgggttgggaggctgctcaggtctctggctgaggggggaggtgtgatcctggaggccagggtggaggcggcaggggcccggaggggctgacaggccctcctggctcgctcgctccccagtctgtgggaaacggtataagaaccggccggggctcagctaccactacacccacacccacctggccgaggaggagggggaggagaacgccgaacgccacgccctgcccttccaccggaaaaacaaccataaacgtgagctggcaggccaggtgggggtggccaggggccctgggagtggggaagaggagcccagctgggggt

SEQ ID NO: 7592 - DNA, 2326 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgccca

SEQ ID NO: 7593 - DNA, 1562 bp, Homo sapiens
gcggcagagcgggcggcgcaggccgggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggca

SEQ ID NO: 7594 - DNA, 2799 bp, Homo sapiens
agtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaa

SEQ ID NO: 7595 - DNA, 1135 bp, Homo sapiens
agcagcattattcagaatagacttaaaaagctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtcacccaacctgcctgcagtttaccctgaacatgaccgaggctgtcaagacctacaagtggcagtgcatagagtgcaaatcctgtatcctctgtgggacctcagagaatgatgaccagctactcttctgcgatgactgtgaccgaggctatcacatgtactgtttaaatcccccggtggctgagcccccagaaggaagctggagctgccacttatgctgggaactgctcaaagagaaagcctcagcctttggctgccaggcctagg

SEQ ID NO: 7596 - DNA, 2271 bp, Homo sapiens
acattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaag

SEQ ID NO: 7597 - DNA, 1138 bp, Homo sapiens
atggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtcacccaacctgcctgcagtttaccctgaacatgaccgaggctgtcaagacctacaagtggcagtgcatagagtgcaaatcctgtatcctctgtgggacctcagagaatgatgaccagctactcttctgcgatgactgtgaccgaggctatcacatgtactgtttaaatcccccggtggctgagcccccagaaggaagctggagctgccacttatgctgggaactgctcaaagagaaagcctcagcctttggctgccaggcctagg

SEQ ID NO: 7598 - DNA, 5055 bp, Homo sapiens
aataatgcacctgactttaccaggggggaacaaccagccgagtagaacaaggaacagatgtaaagggaataaaaggagagagaaaaagagatgagattcgtttaaagaaatccaggggcagaagaggtggctgccgcggcagaggcagctagagcttacttccctgtctgcgtgagctgcaggcagaggacgctttcaccagttgcagatgtaacctcgggaattcctgggccgtcggtttgtttgccaaacaaagtcttttcttctctggctcagacactgaagaggctcctggatttttctgcgatcctgccacaagctggcagttacccgagagccttcccaaggagctggaggagaaatgagcccttgtgggcggaagatgggcgaagggcgtcagcagcggcgggctccggtcgggaagctccttctgctccccgggaggagagatacaccccatgggcggtcaggcagcagcggcgccaggacgcagcgctccctgctctggctcttggtgcacgtgtggctgtgggcggcctcgggctcctctgcccagttgttcaacctcaccctttccgtagatgaggggcttcccccggacacgctggtaggtgacatccgcgccgggctgccggccgcgcagcagcaggaggggagcggcttctttctgtcggaggactccgatgactccccgctgctggacgacttccacgtgcacccggacaccggcatcatccgcactgcgcggcgcctggaccgcgagcggcgggaccactacagcttcgtcgccgccacgctgctgggcgctgtggtgcaggtggagattcgcgtcaacgacgtgaatgaccactcgccccgctttcccctcgactccctgcaactcgacgtctccgagctcagcccgccagggaccgccttccgcctgccagttgcccacgatccggacgccggactgttcagcactcagggctacaccctggtgcaaccgtccgacctgcccaaggaccccgcaggcccgttcttccagttgcgctaccggactccggggccactaccgtcaccgcttttgccaggctcctcgtcacccctggagcctctagatctggtgctgctgcggcgcttggaccgagaggaggcggcggcgcaccggctgcagatcgaggcatgggacggcggccgaccccggcgcaccggcctcctgagcgtggagctgcgcgtgctggatgagaacgacaacccgccggtctttgagcaggacgagtaccgcgccgcggtgcgcgaggacgcccagccgggcgccgaggtctgtcgcgtgcgcgccaccgaccgcgacctggggcccaatggcttcgtgcgctacagcgtccgcgcccggcaagtgcctggggcgggtagcggcggcggggcactgggcgacgcggcctacttcgcggtggaggagctgagcggcgtggtgcgagtgtggagacctctggaccgcgaggcacaggcctggcaccagttggtggtggaggcccgcgatggaggcgccgagcctgaggttgccacggtgcgcgtgtccatcgccgtgctggacgtgaatgacaaccggccagcaattcacgtgctctttctcacagagggaggcgtcgcccgtgtctctgaaggcgcccgaccgggcgactacgtggctcgcgtctcggtgtctgacgcggacggtgactgggagaaggaagatgaggccacaggggagcttggtgtgggtcttggagacgggagcatctctctgtccttggaaggcggagagggagacttcgcgttgctacccggcggccccccaggggtatttttcctttgcgtggaggggcccctggacagagagagccgcgatctgtatgagttactactggtggccacggacgcggggtccccgccgctgagcacggaggagacgctgctactccgggtcgctgacctcaatgaccaaccacctctcttcagccaacagcattacaaggcctcagtgtccgaggccgcggcccctggcactgtagtcatgtgggtcagcgcctccgatgccgacgaggcaggcagtgatcacgcctggctgcgctacactgtagtccaactctcggctccctgcaatctcggctccctgcaatcaaagatggtccacaccgcagagtgtggaccatcttttgccattgattccgaaagcggtgcgatcagcactatccggactctagaccgagaggtccaggaggcggtggagctgaaagtggtggcccaggacctcggagagcccccactctctgccacctgcctggtgagcatcaccgtagatgatgtgaatgacaatgagcccatcttctggaggcaggtgtacaatgccaccattgcagagcatgccccggttggacactgctttctgcaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatgggggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagctagacctatgcctctgaagggaaaaacagcatttgggaagcagtcgtgcaaaaaacaaacaaacaaacaaacaaacaaaatcctgacctgaatctggtcagttctctagatctgcctcccaatttaaggaaaacataagaatagaggaacatattatgctacacgttggagatgcaacagcaaatctagatcatggaaaatgtcaggatacaagttccagtttattcaacaaataaattgcaaggacaaatagagagatgggtggcaggaatccatagattaaagaaatatgcaatatatggactttattttgatcttaatgtaaacaagaaaaataaagagtatttatgggatggttgaaaatttgaaaacttactgaatatttggtgatactgtgaaccattattaatttttaaggtataatatggtactgtgatgattgtgttaaaatatttattttttaaagatgcattttgaaatatatacagaagaaataatatgacttctggaacttacttcaaaaaaaatgggagaagcgaagtatatacatggggaatagatgaaataagattggccatgagctgatcattgttgaagctaggtgatggactcgtgaaagtttattataccattttgtccacttttttgtatgcattttccataataaaaattttt

SEQ ID NO: 7599 - DNA, 8912 bp, Homo sapiens
atgagactggatgagataacgaaatcagagaatgaagacggagaaaagaagatgtttactcagcagtttgaaagtactgatgcctgtgtatatgaggtgtatgtgaaaataaattccattgtgaaatctcagagtcagtgtggattgaaaagaggtagtcccgagactgagctctggggtgctatagtgttcagaagccaggaagagaacgcaaaaccagtgaaggaaactgaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatggggatgagcagagaatgacacatttagccctggtgaagggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggactctatagtccagaggtagaaattctgagtgctgtcaacttttcagcagacaaggaagtaatgaacagtttagagatgtttttacctctgctaaggcacttcaagaaggttgaaagagatgaggaagctgcagaaaaaaaatttgaagctagcagaggttggttcatgaggtttaagggaagacgccatctccattacctaaaagtgcaagatgaagcagcaagtgctgatggagaagctgcagcaaggtatgtagcaaatctagctaagattcttggtgaaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtccagcaggcaccatctatgtcataacctgggcagatggtgctgctgcctttagtgggacagactttgcattcagttctgatgaacttcaagcctttgttctcaagtctctgttctgtgaattaggagaaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagaagatagttctgatcactttaagattgacgccaacaatggtgaaataagaacaaccacaatactttcgtatgattatagaccttcctacagaatgagtgtcattgccactgaccagggagtgcctcctcttcaaggacaggcagttgttaatattcaggtgatcccactatccaaagggagagcaatcatgtctcagaatattagacatttaattataccagaaaatttgaagcccacaaaaataatgagcttgataaagtcatctgatcaccttcaacaacattataatggaaagttacattttagtattgttgcagatgataaggatggacactttgaaatagacagctcaaccggagacttgtttctttctaaggaacttgattatgagacgacatctcattatcttttcagagtgattactacagaccatagcaaaaacctttccctgagtagcacagtcttccttagtatcgatgtggaagatcagaatgaccattccccatctttccaggatgagctcattgtgatcagtgtagaggagaatgttcccataggaaccctggtgtatgtcttcaatgccaaagatgatgacggcagttttttgaacagtagaatacaatactacattgaatcccacaaccctggcacgaatccatttctcatccacccctcatttggcacactagtcactgtgtcccgtcttgacagagaaagcattccaactgtcatcctgacagtaacagcatctgatcaggctgtgaatgtgacagaccggcgactgagatcactgacagcacaaatagtgattttggatgtaaatgaccacaaccccacttttatttctttccccaatgcccatgtcaaagaggatgtcacagtgggctccttggtccaccacataactgctcacgatccagacgaaggaaggaatggaaaagtaacatacagcatcctctcaggaaatgaaaacatgacgtttatgctagatgagtcatcaggcttactaaccacaacctgtcctttggattatgaaatgaaaactcagcatattctgactgttctggcactggatgatggcacaccagcactttcttcatcccagactttgacagttactgttcttgatgtaaatgatgaagctccagtatttaagcagcacctgtatgaagcctcagtgaaagaaaaccaaaatccaggggagtttgttaccagggttgaagctctggacagagattcaggagtcaattccaagcttcagtttgaaatcatgccaggtgcttcatttgaattattcgagataaattctgacactggagaggtagtgacaaccaccatacttgacagagaaattcaagaagtcttcacccttcgagtactagtacgagatgggggattcccttcattgtccagcaccacaacaatcctctgcactgttgaagatgaaaacgatcacgcaccagagtttattgtttccagttatgacattgaggttctggaaaaccaggaaccagaggttgtctatacggttttagcctctgatatggatgctggcaataacagagctgttgaatatcacataattgatggaaatactgatgagtgctttactataaatgagatgtcaggagaactctcaaccactcgtgctttggaccgggagcaaatcagcaattttacccttgtcattctgtgctctgacctgggagatccacctaggagctctgtaatacacctgcaagttagagttttggatgccaatgaccacagtccttcttttcccacactttattaccagtcctctgtgagagaagatgctgaagtgggaacagtggttcttgtgctttcagctgtggacaaggatgaaggcctgaatgggcaaactgagtattttctgactgatgaggcttctggtgcattcaccattgatcctatgtcaggcacattgaaaaccagcaacaccctcgaccgtgaagccagatctcagcatacatttagtgctgtggccagagactgtagcatccagggttcacgaagcaccactgtaattataaaagtatatgtcactgatgttaatgacaatgatccagttttggaacagaacccttttgatgtgtttctttcccccgagtcgcctacaaaccagacaactgtcattgtgagagctgatgacctggacttggggcccaatggaactgtggtttttagttttgcagagacccagtcaatgttttctattgataaatacacaggagaaattcaatttcagcaaaatccatcttcagaatacttccctatctggctgcagttaaaagttacagaccagggcattccagccaggacaaccacgggtctcttggtcattcacatggaaggagaagatgtaaagatttccttcagccaccacctgtataaagggctcgtgactgaaaattgtgaggcaggtacttctattgtgactgttaaagcttttgctcctgactcaattcaggacagcatgaaatattcaatttttagtggaaatgaagatggagttctttccctgtgctctaagtcaggacaactcactgtgaaagaacccaagtttcttgattttgaagtcagaaatgaggttcaactcatcgttttagctgaaagtagtgggcatagagcctattgcaaagtagcagtcttgatacaggatgagaatgataattcaccatgctttgaacaaagcatttaccaggcatcagtgtctgaaagccaactctacaatgctcatgtcatacaggtttttgctaccgacttggacagtggtttgaacggcctgattgagtattctattctgtctggcaaccaagaagaagcattccagattgatgcactgagtggtgtgataacaacaaaagcgattctagattacgagctcaccagctcctacagcttgattgtccaagccacagataaagggatgcccaggctttctaatacgactgtaatcaaggtacaggtgactgatataaatgacaatgccccagcttttctcccctctgaagcagtggaaattacagaagattctttgcctggtgtaattgtgactcatgtgtcagttcatgatgtggatttgaattcagctttcatattcagttttgccaaagagagtaatcctggaaccaagtttgctattgatcagaacactggagtggtggtgttggtgaaaacattggattttgaagaaatgactgaatatgagctgctcatccaaatttctgattcagtgcactacacagagggagcacttgtagtccgtgtgctggatgtcaatgataatccaccagtgttttctcaagatttctatcaggtcacagttcctgaatcaatacctgtggggtattcagtgctgactctgtcagccacagacttagaaagcaatgagaacatttcttacagaattctatcctcttctaaggaattctccattgatcctaagaatggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaataaaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagacactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccagcaactcgagattgggctcatttttatctaaaagcaagtgatgtaatttagttagagtttttaaaacttccccattaaagtttctccaatttc

SEQ ID NO: 7600 - DNA, 2553 bp, Homo sapiens
agatccccatcctctccttgtgtgtgcgcgcttcatataatctcctcctttttggcaaaagaaataatgcacctgactttaccaggggggaacaaccagccgagtagaacaaggaacagatgtaaagggaataaaaggagagagaaaaagagatgagattcgtttaaagaaatccaggggcagaagaggtggctgccgcggcagaggcagctagagcttacttccctgtctgcgtgagctgcaggcagaggacgctttcaccagttgcagatgtaacctcgggaattcctgggccgtcggtttgtttgccaaacaaagtcttttcttctctggctcagacactgaagaggctcctggatttttctgcgatcctgccacaagctggcagttacccgagagccttcccaaggagctggaggagaaatgagcccttgtgggcggaagatgggcgaagggcgtcagcagcggcgggctccggtcgggaagctccttctgctccccgggaggagagatacaccccatgggcggtcaggcagcagcggcgccaggacgcagcgctccctgctctggctcttggtgcacgtgtggctgtgggcggcctcgggctcctctgcccagttgttcaacctcaccctttccgtagatgaggggcttcccccggacacgctggtaggtgacatccgcgccgggctgccggccgcgcagcagcaggaggggagcggcttctttctgtcggaggactccgatgactccccgctgctggacgacttccacgtgcacccggacaccggcatcatccgcactgcgcggcgcctggaccgcgagcggcgggaccactacagcttcgtcgccgccacgctgctgggcgctgtggtgcaggtggagattcgcgtcaacgacgtgaatgaccactcgccccgctttcccctcgactccctgcaactcgacgtctccgagctcagcccgccagggaccgccttccgcctgccagttgcccacgatccggacgccggactgttcagcactcagggctacaccctggtgcaaccgtccgacctgcccaaggaccccgcaggcccgttcttccagttgcgctaccggactccggggccactaccgtcaccgcttttgccaggctcctcgtcacccctggagcctctagatctggtgctgctgcggcgcttggaccgagaggaggcggcggcgcaccggctgcagatcgaggcatgggacggcggccgaccccggcgcaccggcctcctgagcgtggagctgcgcgtgctggatgagaacgacaacccgccggtctttgagcaggacgagtaccgcgccgcggtgcgcgaggacgcccagccgggcgccgaggtctgtcgcgtgcgcgccaccgaccgcgacctggggcccaatggcttcgtgcgctacagcgtccgcgcccggcaagtgcctggggcgggtagcggcggcggggcactgggcgacgcggcctacttcgcggtggaggagctgagcggcgtggtgcgagtgtggagacctctggaccgcgaggcacaggcctggcaccagttggtggtggaggcccgcgatggaggcgccgagcctgaggttgccacggtgcgcgtgtccatcgccgtgctggacgtgaatgacaaccggccagcaattcacgtgctctttctcacagagggaggcgtcgcccgtgtctctgaaggcgcccgaccgggcgactacgtggctcgcgtctcggtgtctgacgcggacggtgactgggagaaggaagatgaggccacaggggagcttggtgtgggtcttggagacgggagcatctctctgtccttggaaggcggagagggagacttcgcgttgctacccggcggccccccaggggtatttttcctttgcgtggaggggcccctggacagagagagccgcgatctgtatgagttactactggtggccacggacgcggggtccccgccgctgagcacggaggagacgctgctactccgggtcgctgacctcaatgaccaaccacctctcttcagccaacagcattacaaggcctcagtgtccgaggccgcggcccctggcactgtagtcatgtgggtcagcgcctccgatgccgacgaggcaggcagtgatcacgcctggctgcgctacactgtagtccaactctcggctccctgcaatctcggctccctgcaatcaaagatggtccacaccgcagagtgtggaccatcttttgccattgattccgaaagcggtgcgatcagcactatccggactctagaccgagaggtccaggaggcggtggagctgaaagtggtggcccaggacctcggagagcccccactctctgccacctgcctggtgagcatcaccgtagatgatgtgaatgacaatgagcccatcttctggaggcaggtgtacaatgccaccattgcagagcatgccccggttggacactgctttctgcagcttatatctgctcaagttgcctttgtcaaaatcaaacaaaaacaaaaggaaatacaggaaaaacaaaatcttgcctag

SEQ ID NO: 7601 - DNA, 2109 bp, Homo sapiens
atgggcgaagggcgtcagcagcggcgggctccggtcgggaagctccttctgctccccgggaggagagatacaccccatgggcggtcaggcagcagcggcgccaggacgcagcgctccctgctctggctcttggtgcacgtgtggctgtgggcggcctcgggctcctctgcccagttgttcaacctcaccctttccgtagatgaggggcttcccccggacacgctggtaggtgacatccgcgccgggctgccggccgcgcagcagcaggaggggagcggcttctttctgtcggaggactccgatgactccccgctgctggacgacttccacgtgcacccggacaccggcatcatccgcactgcgcggcgcctggaccgcgagcggcgggaccactacagcttcgtcgccgccacgctgctgggcgctgtggtgcaggtggagattcgcgtcaacgacgtgaatgaccactcgccccgctttcccctcgactccctgcaactcgacgtctccgagctcagcccgccagggaccgccttccgcctgccagttgcccacgatccggacgccggactgttcagcactcagggctacaccctggtgcaaccgtccgacctgcccaaggaccccgcaggcccgttcttccagttgcgctaccggactccggggccactaccgtcaccgcttttgccaggctcctcgtcacccctggagcctctagatctggtgctgctgcggcgcttggaccgagaggaggcggcggcgcaccggctgcagatcgaggcatgggacggcggccgaccccggcgcaccggcctcctgagcgtggagctgcgcgtgctggatgagaacgacaacccgccggtctttgagcaggacgagtaccgcgccgcggtgcgcgaggacgcccagccgggcgccgaggtctgtcgcgtgcgcgccaccgaccgcgacctggggcccaatggcttcgtgcgctacagcgtccgcgcccggcaagtgcctggggcgggtagcggcggcggggcactgggcgacgcggcctacttcgcggtggaggagctgagcggcgtggtgcgagtgtggagacctctggaccgcgaggcacaggcctggcaccagttggtggtggaggcccgcgatggaggcgccgagcctgaggttgccacggtgcgcgtgtccatcgccgtgctggacgtgaatgacaaccggccagcaattcacgtgctctttctcacagagggaggcgtcgcccgtgtctctgaaggcgcccgaccgggcgactacgtggctcgcgtctcggtgtctgacgcggacggtgactgggagaaggaagatgaggccacaggggagcttggtgtgggtcttggagacgggagcatctctctgtccttggaaggcggagagggagacttcgcgttgctacccggcggccccccaggggtatttttcctttgcgtggaggggcccctggacagagagagccgcgatctgtatgagttactactggtggccacggacgcggggtccccgccgctgagcacggaggagacgctgctactccgggtcgctgacctcaatgaccaaccacctctcttcagccaacagcattacaaggcctcagtgtccgaggccgcggcccctggcactgtagtcatgtgggtcagcgcctccgatgccgacgaggcaggcagtgatcacgcctggctgcgctacactgtagtccaactctcggctccctgcaatctcggctccctgcaatcaaagatggtccacaccgcagagtgtggaccatcttttgccattgattccgaaagcggtgcgatcagcactatccggactctagaccgagaggtccaggaggcggtggagctgaaagtggtggcccaggacctcggagagcccccactctctgccacctgcctggtgagcatcaccgtagatgatgtgaatgacaatgagcccatcttctggaggcaggtgtacaatgccaccattgcagagcatgccccggttggacactgctttctgcagcttatatctgctcaagttgcctttgtcaaaatcaaacaaaaacaaaaggaaatacaggaaaaacaaaatcttgcctag

SEQ ID NO: 7602 - DNA, 5051 bp, Homo sapiens
aataatgcacctgactttaccaggggggaacaaccagccgagtagaacaaggaacagatgtaaagggaataaaaggagagagaaaaagagatgagattcgtttaaagaaatccaggggcagaagaggtggctgccgcggcagaggcagctagagcttacttccctgtctgcgtgagctgcaggcagaggacgctttcaccagttgcagatgtaacctcgggaattcctgggccgtcggtttgtttgccaaacaaagtcttttcttctctggctcagacactgaagaggctcctggatttttctgcgatcctgccacaagctggcagttacccgagagccttcccaaggagctggaggagaaatgagcccttgtgggcggaagatgggcgaagggcgtcagcagcggcgggctccggtcgggaagctccttctgctccccgggaggagagatacaccccatgggcggtcaggcagcagcggcgccaggacgcagcgctccctgctctggctcttggtgcacgtgtggctgtgggcggcctcgggctcctctgcccagttgttcaacctcaccctttccgtagatgaggggcttcccccggacacgctggtaggtgacatccgcgccgggctgccggccgcgcagcagcaggaggggagcggcttctttctgtcggaggactccgatgactccccgctgctggacgacttccacgtgcacccggacaccggcatcatccgcactgcgcggcgcctggaccgcgagcggcgggaccactacagcttcgtcgccgccacgctgctgggcgctgtggtgcaggtggagattcgcgtcaacgacgtgaatgaccactcgccccgctttcccctcgactccctgcaactcgacgtctccgagctcagcccgccagggaccgccttccgcctgccagttgcccacgatccggacgccggactgttcagcactcagggctacaccctggtgcaaccgtccgacctgcccaaggaccccgcaggcccgttcttccagttgcgctaccggactccggggccactaccgtcaccgcttttgccaggctcctcgtcacccctggagcctctagatctggtgctgctgcggcgcttggaccgagaggaggcggcggcgcaccggctgcagatcgaggcatgggacggcggccgaccccggcgcaccggcctcctgagcgtggagctgcgcgtgctggatgagaacgacaacccgccggtctttgagcaggacgagtaccgcgccgcggtgcgcgaggacgcccagccgggcgccgaggtctgtcgcgtgcgcgccaccgaccgcgacctggggcccaatggcttcgtgcgctacagcgtccgcgcccggcaagtgcctggggcgggtagcggcggcggggcactgggcgacgcggcctacttcgcggtggaggagctgagcggcgtggtgcgagtgtggagacctctggaccgcgaggcacaggcctggcaccagttggtggtggaggcccgcgatggaggcgccgagcctgaggttgccacggtgcgcgtgtccatcgccgtgctggacgtgaatgacaaccggccagcaattcacgtgctctttctcacagagggaggcgtcgcccgtgtctctgaaggcgcccgaccgggcgactacgtggctcgcgtctcggtgtctgacgcggacggtgactgggagaaggaagatgaggccacaggggagcttggtgtgggtcttggagacgggagcatctctctgtccttggaaggcggagagggagacttcgcgttgctacccggcggccccccaggggtatttttcctttgcgtggaggggcccctggacagagagagccgcgatctgtatgagttactactggtggccacggacgcggggtccccgccgctgagcacggaggagacgctgctactccgggtcgctgacctcaatgaccaaccacctctcttcagccaacagcattacaaggcctcagtgtccgaggccgcggcccctggcactgtagtcatgtgggtcagcgcctccgatgccgacgaggcaggcagtgatcacgcctggctgcgctacactgtagtccaactctcggctccctgcaatctcggctccctgcaatcaaagatggtccacaccgcagagtgtggaccatcttttgccattgattccgaaagcggtgcgatcagcactatccggactctagaccgagaggtccaggaggcggtggagctgaaagtggtggcccaggacctcggagagcccccactctctgccacctgcctggtgagcatcaccgtagatgatgtgaatgacaatgagcccatcttctggaggcaggtgtacaatgccaccattgcagagcatgccccggttggacactgctttctgcaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatgggggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagctagacctatgcctctgaagggaaaaacagcatttgggaagcagtcgtgcaaaaaacaaacaaacaaacaaacaaaatcctgacctgaatctggtcagttctctagatctgcctcccaatttaaggaaaacataagaatagaggaacatattatgctacacgttggagatgcaacagcaaatctagatcatggaaaatgtcaggatacaagttccagtttattcaacaaataaattgcaaggacaaatagagagatgggtggcaggaatccatagattaaagaaatatgcaatatatggactttattttgatcttaatgtaaacaagaaaaataaagagtatttatgggatggttgaaaatttgaaaacttactgaatatttggtgatactgtgaaccattattaatttttaaggtataatatggtactgtgatgattgtgttaaaatatttattttttaaagatgcattttgaaatatatacagaagaaataatatgacttctggaacttacttcaaaaaaaatgggagaagcgaagtatatacatggggaatagatgaaataagattggccatgagctgatcattgttgaagctaggtgatggactcgtgaaagtttattataccattttgtccacttttttgtatgcattttccataataaaaattttt

SEQ ID NO: 7603 - DNA, 742 bp, Homo sapiens
tcatctctgcttcacaatgccgatgatttagctgggaggacccaaaatgctggaaaagctgatgggtgctgattctctccagcttttcagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatctctctttttattaaatgtgcttcaagttttaaca

SEQ ID NO: 7604 - DNA, 1009 bp, Homo sapiens
ccaaacttctttcatttaaagaaccaaacttctttaaataaaaatgactcacaataatttaatattttaccatttacaaagagattaactacaacaatattgatcttgagttaatttcccacgaataacattttcatttcttaaaatttgctgaatggaaagccagaaagtagagtgaagcaagtaatgtgtgtgatttggaaagggcatggcaggaggtctcatctctgcttcacaatgccgatgatttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatctctctttttattaaatgtgcttcaagttttaaca

SEQ ID NO: 7605 - DNA, 823 bp, Homo sapiens
ttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagagctgggacttctaaccaatggaacatgggaaaggtgatgacacttgactccggtgatgaggttacctttcacaagacctggccaactgagaccggatctccttacaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgt

SEQ ID NO: 7606 - DNA, 1756 bp, Homo sapiens
agtgcagtgccgagccccacccctcaagccgtgccctgtccatagctccagactttgaccctgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacaga

SEQ ID NO: 7607 - DNA, 640 bp, Homo sapiens
gagagatccagcctctcaaacatccagcagagagaccataggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagcc

SEQ ID NO: 7608 - DNA, 3734 bp, Homo sapiens
ctcgagggcttctagccaccgtccccgccagcgccgcgccccgccacagggcggcatgagcccacccgcggccgcagccctagcgccctgctcctccgcctgggcggcccggctgcggtgacggctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattgaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgctgttaagtttgttatttgggtataaaaccagatgtttacacctgtaaa

SEQ ID NO: 7609 - DNA, 2571 bp, Homo sapiens
gctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattgaactgtttgaggcgaagagatgctggtttgttgaatcagttgcaagagcttgacaagcagataagtgacctgagactggatgtagaaaagacatctgaagagcacctggagacagacagtcggcctagctcagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcagatctcataggattgttggaatataaagaaggccactgtgaagaccaggcctcaggggcagtttgccgttccctctccacaccacaatttaattcccttgatgtcattgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttt

SEQ ID NO: 7610 - DNA, 2942 bp, Homo sapiens
ggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagaggcagggtggctggagtacagacggtggagggcgactgctggtcttcgccccagggagggaggacgagggagggccagctcagagcaggggtgccggcaggggcgggccccagcagcagggatacatgccccttgagggtccccagcagtctggcagccttccagaggagggctccaagccctcaaacagctgtgtcctcagggagaccatggtgcaggcttctcccagctcaaaggcccagcagacaccctcagctcaggactatggacgaggcaacatcatatccccatccaggatgctggacaagagcccctcaccggcctctgggcactttgcccacccatcctttgctgccagcctgaaaatgggtccccccaagagcaaggctgaaaaaatcaagagaagtcccatggacaaggtgctgaggtttgcaaggcagccgctgcttctactggacaggcctgagggagcccatgcagccccccagccatccctggagtgggaccctgcccactggcccacagggaggggcgggctccagcggaggccagccctggcctgggaggcacccgggcgctcctgttctgagtccaccctctaccccatgcctgtcctcgtccccttggcagtggccccgcaggagagccaccggacctcagcccaagccctgttcccctttgaggcgtcactgctcacctcagtggccaggaggaagcatcgccgctggcagtccaccgtggagatctcggcccgggcccgcctggccagctgtcctgagtctaacctggggccccccaggcccgtggccaggagagcaggtggcccactggcccggggccgtccctcactggtccgccaggacgcctacaccaggagcgactcagagccctccaagcactcggccgagtgtgacccgcggttcccgtcagtcatcccggagaccagcgagggagagtccagtgaccacaccaccaaccgattcggagaccgtgagtccagcagcagcgacgaggagggcggcgcccagagcagggactgtgacctggcactgggctatgtggcggccgggcatgcggagctggcctggacccaggaggccccggtcagctcggggccactcctgtcccccgtgcccaagctgtgccgtattaaggcctccaaggccctgaagaagaagatccgcaggttccagccgacggccctgaaggtcatgaccatggtgtgaggtgcagtgactgcgtcaagagaagcctgctgcacacaggggccctttccatgcagtgtcctgtgcatgtctgggtttcagtgtcgtcttgccaagtcgctttatcttccgaggccaccgtttaacaggagtccccgcagatgggttctgccctgtggagtatggccgtgagtccccgccccagcaaagacttccatgcggagctctggtttcagatgccagcagcctccccggccgacctagtgtctcttttcaaggtctgcccaggatgctgcttcccggcatgcaccttgtttccatgttgtcatcctcccatggcttcccctgccctcactcccctctggctggggaagtgtttcccaatcctttgaccattcctccccaaaagcattttaaagaggcggttgcaggactctgagctggaaattgaatttgagtttaaactccacgttaagctgtcagcatacacaaacacccaaattatgccatgatctcaaataaaaggaacattttttttccctcttttaa

SEQ ID NO: 7611 - DNA, 2026 bp, Homo sapiens
ctgcggagccgggggcggagagaggaggcgcaggaggacccgcgacacagctcgggatccgcgcgcgctgggcctccggcgccgctcgtggggttcgggaggccgggaccctgcccgggagatgtggacgccgggcggacccccggggtccgcgggctgggaccgccgtaggttgggcgcgaggttgcgcgcggcgttcgcggggctgcaggagctgcaggggctgcgagccacgcagcaggagcgggtacggggcgccctggccctgcagcccccgcccgcgcccgccgcgccctgcggcccccacggcctccacggccccgagcagcagctggaggcggcgctggccgcgctgcaggagcagctgtcccggctgagacaacaggacatcggcctgaagacccacctggaccagctggacctgcagattagcaagctgcagctggatgtgggcacagcctcaggggaggccctggacagcgacagcaggcccagctcaggcttttacgagatgagcgacggtggatcctgctccctgtccacgtcctgtgcctccgtctgcagtgaccacatctctccctcgctgggcagtttgttgcctgtggcccaggcccacaaggccaggcccagcatgggggactggaggccccggtcggttgatgagactactgtgccagcgtggagaccccaggctaccgaggagggcgccaggcccccagggagcgtggaggatgcaggccagccgtggggcacattctggcccaggcctgtgtctacagagctgtgcaatgctccaggtgaacttgacatgcatgctccgcctgcaggctgcacctccagttcactgacaggtgtaggttctggtttgagaggaaagtgtggcctctgtggctgtcagctccctttctgctcagtgaacacaagttcaaagacaaaatcatcaggaatttcaagacagcaatgacagagcactacaccaagctgggggctgcattgactgaccagtcacaggctggaagtcgggtcctggccacaggcccagcttcttctcccgatatcatcggcccccctctgcccgccaagtcactctgctttccccacagtgagccagtgggagctgcagagaagtgtccagaaaggactgctggtcagtggaatttcctttacgtggaaagttgaagtgagggagtaatggacgtaagagagaatggtttctccctaacaaatagactggaaattccaatccttctactttctgtgtgtttttctagcatgactgcaagtgctggggccataagcaccatgttcagcagcacccaggaagcaaaagtagttgacagaatgttagtgagcattccttcttgtttttatttttttttaaagccccttctatatttcataatttttgtgattttgggtaaatacaatgttatcataagttaaggaaaagttaatctttttaggctaggaaaagttccagtttacgtgcatatatattattgcaaaatgatgtgaaaatttaatattttttgagataattgatatttttcattcactatgttaataagatgaatcatattaacaaaatgtccattgctaaaccaatcatgcattcataggatgaacaatgtttggttatggtgtttttgtttgtacttttaaatggtacttaaacataattagggagaagatgagctccaaagcacctggcacagctccagcaggctcagctaatggccggtcttctcatttaccaaacccacgtggccaccccgacctcagacgaattttttttacaaagtccagacattcaattatttacaatgtgtctttttaggacactgccagaattaggttgtaaatttttttttaggattgtatcttatgttcatagaagaaattggcctatgaaatttctttcatataatactcacatctggttttcatcccaaagctaaaccagcccataaaagcagctgtgatggttttcttcttcttatatttcaataaatggtatgtaaaagac

SEQ ID NO: 7612 - DNA, 2834 bp, Homo sapiens
gctggggcggggaggtgggaccgggagaggggtggccgcggggcccggccgggctggggcggggggccgcagccatgatccgggccttctcgttcccggtgagccctgagcggggccggctgcggggctggctggagggtagcctggccgggctctgcgagttacattggctccgggagaggcaggagtaccgcgtgcagcaggcgctgcggctggcccagcccggaatggggggcgccgaggccgaggacgaggaggacgccgatgaggatgaagatgcggcggcggcgcgccgggccgcagcggccctggaggagcagctggaggccctgcctggtctcgtctgggacctgggacagcagctgggagacctgagcctggagtctgggggcctggaacaggagagcgggcgtagctcgggcttctatgaagatcccagctctacaggaggtccagattcaccaccctcaaccttctgtggggacagtggcttctctggatccagctcctatggtcgcctgggtccctctgagccccggggcatctatgccagtgagaggcccaagtccctaggagacgccagtcccagcgctccggaggtggtgggcgcgcgggcagcggtgccgcggtccttctcagcgccctacccgacggcaggggggtccgccggcccggaggcctgctcctcggcggagcggcgggcccgcgccgggccctttctgacgcccagccccctgcacgccgtggcgatgcgcagcccgcggccctgcggccgccctcccaccgactcgcccgacgcggggggcgcagggcggcccctggacggctacatctcggcgctcctgcgcaggcgccgccgccggggggcgggccagccccggaccagtcccgggggcgcggacggcggcccgcggcgccagaacagcgtgcgccagcggccgcccgacgcgtctccgtcccccggcagcgcgcgacccgcgcgggagccctcgttggagcgcgtcgggggccaccccaccagccctgccgccttgagccgcgcctgggcgtcgtcgtgggagtcggaggcggcacccgagcccgctgcgccgcccgccgccccctcaccccccgacagcccggctgagggccgcttggtgaaggcgcagtacatcccgggcgcgcaggcggccacccgaggcctccctggccgcgccgcccgccgcaaaccgccgccactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacata

SEQ ID NO: 7613 - DNA, 3907 bp, Homo sapiens
ctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtg

SEQ ID NO: 7614 - DNA, 1274 bp, Homo sapiens
actgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaaaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatc

SEQ ID NO: 7615 - DNA, 2997 bp, Homo sapiens
aaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgcctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccctctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgcca

SEQ ID NO: 7616 - DNA, 1810 bp, Homo sapiens
gtagggcggatctcgcagctacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcagtgacccaaggcagggctgcgggccagcagcgatggacagaatcactagatggtgtgatgggacctcctgcaagtcacacatgtcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgcca

SEQ ID NO: 7617 - DNA, 862 bp, Homo sapiens
cttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccagaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcagatgcaagtccctttgaggccccgacgaccctgggcagcatgcaccataccag

SEQ ID NO: 7618 - DNA, 1931 bp, Homo sapiens
gacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatcta

SEQ ID NO: 7619 - DNA, 1972 bp, Homo sapiens
tgaacaccgccggccggaccgcgggctgcgtcacggggaccgggaggcgtacggcgacgcggagcagcgcctttgcggcgtgcgacccgcccccgccgtccctccctccctcccctcagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaa

SEQ ID NO: 7620 - DNA, 578 bp, Homo sapiens
accggccaagggtccccacggggacgctgcgacacagcgggctcactccagagacccaaaccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaatt

SEQ ID NO: 7621 - DNA, 896 bp, Homo sapiens
gctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataa

SEQ ID NO: 7622 - DNA, 1027 bp, Homo sapiens
tggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtggtacccaccccgtttttgtgttgtcttccttccttgcccttgtttcattccttttgaaagcgaccactcccctgaagtcctaggacccccttcgtgggctctccctgccgtagacagtctctgcttgcccctgggagacagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatggg

SEQ ID NO: 7623 - DNA, 332 bp, Homo sapiens
gcgaacgcgcggcgcccgggccgctgcccccttccggccccgcggcggccccgcctcctcccccgacttccttccctgagcacggcggcggcggggacgagcaccggcctgcgcgcggagccggcaccggatggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggcctt

SEQ ID NO: 7624 - DNA, 592 bp, Homo sapiens
atcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcag

SEQ ID NO: 7625 - DNA, 794 bp, Homo sapiens
ctcctcccccgacttccttccctgagcacggcggcggcggggacgagcaccggcctgcgcgcggagccggcaccggatggtgggcgggggccagccgtgcgggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaaga

SEQ ID NO: 7626 - DNA, 683 bp, Homo sapiens
agggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcgggcactgccgccctgcactgtagcagatgcctaaataaagtgtggagcctgaagcagaagttttgggagatgcttgccttcctttagaccacattcctcgcctttctcaagatttctccgtgggagacagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccag

SEQ ID NO: 7627 - DNA, 645 bp, Homo sapiens
ggttgccaggcctctcagatgtggggcagcgtaatcagtgggtgaccgtggttcccagcacccactctccactgcatccttgtcttaggcactgccgccctgcactgtagcagatgcctaaataaagtgtggagcctgaagcagaagttttgggagatgcttgccttcctttagaccacattcctcgcctttctcaagatttctccgtggtacccaccccgtttttgtgttgtcttccttccttgcccttgtttcattccttttgaaagcgaccactcccctgaagtcctaggacccccttcgtgggctctccctgccgtagacagtctctgcttgcccctgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaa

SEQ ID NO: 7628 - DNA, 7954 bp, Homo sapiens
cgaggtccggggctgcctcctcgggccgcgccgggccgccccgcactgcgcatgagcgggagccgggcaagcccgtgagaggagccgccgccgccgccgccgtccattcgctgcggagccggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatatggcattataagtacatgtccttccttagacttttaaaaagttttaatgagagaaagtaaatttactcaacaaaataacatgagaaatcctttacgtaatatctttactggggaattcttatttaagcaaggtacactattttttcctcagacttaaatgaatgaagtgttcatttattttttatttgatgataatcaagaagtgagtagtagtagctaacttaatgtacactttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgtaatgataaaatgtttttttaaatgtgaactatttaacatataaatggggacacaaaacctgaattgtgatttctacataatgtgataattagggttcaaattatgactcatcatttaattgattataaatgagtatatttctgaactctttattgcctccatttttacaatcataatatagcaataatttctatttttatttcataggactgtggtgaagttatttatcatgacacctttatctttgatttctgagggaaaggggtgtatattttgtagttaagataaatgagaaagttcctaatagtacaaatgcccttttccaggtttatctttgctatttgttgccatttttcttaaatatttgctttatttgtacccgatttctggaggcaaatagtgctgttttttcaaactcataatatagttacataaatgattttatcagagcattcttgctatcttattttctttcctacctgttgagtaagtagcatttcttgctcaccaactcatttatttgactaggttcagtgtttcctattaatgtgtttttttattttcctttggttgattttgaaaaatctgtcacaaataaggaagttatggtaaaagatgcacagcctttgtagttagtggaattctcaataagtaatgtctttatggagttttaaagggaaattatttaaagggaatcatgttatagttgtccattttttaaattgagattttaaaagtgtttttaagtatagcccaattttctatttacttacaagtgcttcatgattgttttcttttttattttttgccatcatgctgtgcagaaatcataatgtagcttgtaatacttcagagcattggtcttgaagctgtaacttggggctgctgtccttcatgaggtagggccatagcaggcaggccctttcccacttcctttatggcattctacttttatctgttgtaggctgttagtgtttcatattcgatttggtttggggaaaaatactcagttaaaaaaattttttttaatgattggctttagagggactgttacctctttggcatatctgtcagcggaatggaaagaaatggagtcagactgaaattcatgccagcttaatcactgaaggcagcactgctttgaaaagaagaattttcaacccacatcgtaaaaacaaagcctgattggaaacaatgaagtgtttgaaacttaggggcagcatgtaagtggcttaatgagcaaacaaacggaacatactcattttatatttaaaaagtacatatatattcaaatgcatgttcatatgaatattataattttatttcaggttatgaaatattctgagaaaaccttatatctgatggaaaacttgggcaatacccaatacgaagcaagagatttttacaaaaagaaatactatagggcataaggttgggggaagaccaattaatgaaatggctaagggacaatgctaattaaatcgttaacagtgattttgtcacataattacatgacttatagctaaaagagcaatatttaatcagtaagatttagagatgggtgtacttggaatcctttgaaagcagcgtgtttagttttcaagcaaatgctaatgttcttaatcctaatagtatattagacttcgttgtgttgaatatatcaaatgaacgaactatgaaccagagctttaaaatagtgatttgtaagactttgttacaatggtacttaaaaaattgctttgtataatttacacactgtaaaattcacccattgtacatgtacaattaattgtttttagtaaacttaagagttgtgcagtccaattttagaacatgtccatcagcccccaaaatttactcctgctgctctgcggttaatttgctcctgcctccagccccacgcagccacactgatctgctttctgtacagatttaccctttctagaaatttcacagaggtagaatcatgcagttagtcttttatatctggcatctttcacttagcatgtttttgaggttcatccatgttgcagcttatacctgcgtgtagttcctttagttgctgacttagtgttcactgtttggatataccacattttgtttatccattcaccagttgatagacatttggctggcctacaattagtttttttaaattgcgaataataatgctatgaacattcataaatgtctttgtgtggacatgttttcatctcagattcctagttgtggaattgtcaggttgtgtggtaaatttatacctaacgtttttaaaaaaactgctgaactttttccaaagtggctgtacttctagaactattcctgccacagtgcatgcggactgccgtgtctgcacatccttgccaatacttgtcttttttattgcagccatcctggcgggtatttactttatgtgtgtgagttatacctaggcatcccaactcgtgtatcgattggatgtgcagtttgagtgagtttcaagtggcctcagcgattgctgtaaaattagttactctagtagacatgtactctcttggaggtagtattttctgtagtcagtgagggtaataataatacttccagtgggggttccagtccctcagtgatctctggtgagaagaaatgtgtcagcgaagagtggtgctgatggctggtgctttggctctgttattgtttgtaccaaggttgatacagctactcgactagcctatgactgactggtggtggtaattaaactttgtacagattactgtgtgcagatagttactgtcttaatattaagtttcccagagattttacttttgagatagctgagaattaacgactcttggaatttataaaaatttagttgataccatttagttgctgccagctgcctgtgttcttatacataggagacatcggagtgagtgctttttaaaaaattaatggcgtatgtcaggtatatgtaaaaggacaattgcataatgaactcatgttaacatgatcaatccatggccaatcttgatttatctaaatgccattcatctttgaacccctatttattttgaagcaaatcccagatagcaaatcatttcatttgtaaatatttcaatatgtatgtctaaaagataaggactgttaaataaaaccacaattctgttgttagacttaactgttaacagtttgttagtgttaataactacccagcagtgttcaagttgtgcctttttttttttttttccaattcaagtcaggattcaaataagattcctacattgcatacatctcaaatgtcctacccagtggatccccacactctccactctttggcttcaaattcatttttttgaaaaaacaatgattgctttagcactttaaatttctatgcaatttcaaatgtaaggtgaaattttgatgtacttaataaaaaaattctaacgaatatatttttcaagttaatgtagtatataagaagctattatatcaacagattttcctttaacttaaaaatacatcgtgacttgta

SEQ ID NO: 7629 - DNA, 1024 bp, Homo sapiens
attcgctgcggagccggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgagg

SEQ ID NO: 7630 - DNA, 504 bp, Homo sapiens
agggggcaacggccttgcccctgcccctctgccggctccattgtgtctggtcggggactggggtctggggttccggaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagat

SEQ ID NO: 7631 - DNA, 4312 bp, Homo sapiens
gagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaa

SEQ ID NO: 7632 - DNA, 1584 bp, Homo sapiens
agcttcgagccgaggtgcagtgagctggtggggggaccgcgaggcgagcgcgggagcctgggcggcgagccgggtgtgagctgcctgaaaatgcactcggatgccgccgctgtcaatatcagttttagagaatgtggcgtggagaaattctcaaggaaagagtaaaatgctggtgatgtgctgagggaacagaaggagtgtttgtgaatgtgcacacgtccgtttctggtctctcgtgtcagcgtcctacctgcacaaggttaaggcagcattaacagattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgcc

SEQ ID NO: 7633 - DNA, 4207 bp, Homo sapiens
gagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacggcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaa

SEQ ID NO: 7634 - DNA, 1052 bp, Homo sapiens
ggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgtta

SEQ ID NO: 7635 - DNA, 2086 bp, Homo sapiens
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttat

SEQ ID NO: 7636 - DNA, 2073 bp, Homo sapiens
ttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagatatgaggaaactgagactccagtgaggaggcagactgtgtaaaaacccacagattctgatttcacttccgttgctttttccacaccacctgtactgctctactattaaacatggatgcaaattaaagtgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaag

SEQ ID NO: 7637 - DNA, 8947 bp, Homo sapiens
agtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatttctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctattctctcatggacttctcatcctttcttttttcatctccaacagttaaatggtaaggagagcaaagttaattataaaaattagacattttgccaagttagttttcttaccacaataccctcttggcttttttttttttttttttgagatggagtttcactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctta

SEQ ID NO: 7638 - DNA, 8029 bp, Homo sapiens
gtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatttctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctattctctcatggacttctcatcctttcttttttcatctccaacagttaaatggtaaggagagcaaagttaattataaaaattagacattttgccaagttagttttcttaccacaataccctcttggcttttttttttttttttttgagatggagtttcactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttat

SEQ ID NO: 7639 - DNA, 1500 bp, Homo sapiens
cccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatttctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgca

SEQ ID NO: 7640 - DNA, 2469 bp, Homo sapiens
cttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagcttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactcctt

SEQ ID NO: 7641 - DNA, 2402 bp, Homo sapiens
agttggtgagctagggtagcgcactacggttcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 7642 - DNA, 4299 bp, Homo sapiens
tgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttca

SEQ ID NO: 7643 - DNA, 947 bp, Homo sapiens
gtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggctta

SEQ ID NO: 7644 - DNA, 581 bp, Homo sapiens
gtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttgg

SEQ ID NO: 7645 - DNA, 592 bp, Homo sapiens
gacttcgataggtgagtttggtgtagaaaacaaatctttcttcagttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccac

SEQ ID NO: 7646 - DNA, 849 bp, Homo sapiens
gaaagacgcgtgtattagggaacgtctgcaaagaccgcggcggaaagccagggattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctgggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgag

SEQ ID NO: 7647 - DNA, 2711 bp, Homo sapiens
agttcccacttactcctccccagcaagagctaacagccctccttgggtgtgcactttctcctcccctcaggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 7648 - DNA, 547 bp, Homo sapiens
ctttcttcagttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggcc

SEQ ID NO: 7649 - DNA, 300 bp, Homo sapiens
ataagctagtgaagcgctttcttccgagagggatttcgattggtcggtcagagaggttacctggaaatccaacaccgcccaacacccctcccgctccccagtccggggacttcgataggattggagaagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtg

SEQ ID NO: 7650 - DNA, 575 bp, Homo sapiens
agttggtgagctagggtagcgcactacggttcactcttgctttctttgcttcacaggattggagaagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctg

SEQ ID NO: 7651 - DNA, 476 bp, Homo sapiens
aggaagccgcgagatgcgtgacgagcgaagcgcgtgacggaggagcggttggccaacgcagtggcggcagtcggtgtaaacaaggcctcgcgccgctgcgggtcctgcgaccgctcctggctgggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactca

SEQ ID NO: 7652 - DNA, 587 bp, Homo sapiens
agttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcggg

SEQ ID NO: 7653 - DNA, 545 bp, Homo sapiens
agtggcggcagtcggtgtaaacaaggcctcgcgccgctgcgggtcctgcgaccgctcctggctggtgggtggtctcgcgtggggcggttaccgccggcttcagtgggaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtct

SEQ ID NO: 7654 - DNA, 570 bp, Homo sapiens
ggaaatccaacaccgcccaacacccctcccgctccccagtccggggacttcgataggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtct

SEQ ID NO: 7655 - DNA, 5953 bp, Homo sapiens
tgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttctcacgtcttcctcttctcttccagggaagacttggttgctta

SEQ ID NO: 7656 - DNA, 4803 bp, Homo sapiens
gaggggaaggagaggatgtcttctataaaaaagacctaaaatggttgacagctccttaattcgctttatcccaagtgcaaagtgatctctcctgatgcctgccctgaaagtgtaggtcggggaggggggcgaggttaccgctctacaaagtttgacggcaaactcttcctccgcgtactttaaaaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaata

SEQ ID NO: 7657 - DNA, 759 bp, Homo sapiens
gcggccgcgcgtgaggccgagggaggggcggcggcgcgagcggcggcggcggcggttccagcatgaagaggagagctggcctggggggcagcatgaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccag

SEQ ID NO: 7658 - DNA, 2791 bp, Homo sapiens
attgcagggggaggggaaggagaggatgtcttctataaaaaagacctaaaatggttgacagctccttaattcgctttatcccaagtgcaaagtgatctctcctgatgcctgccctgaaagtgaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaa

SEQ ID NO: 7659 - DNA, 671 bp, Homo sapiens
gatcccggtgccagggaccctgcccagttccaggcgtcgccctgacccagaaacgactgggcgccgccgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatga

SEQ ID NO: 7660 - DNA, 713 bp, Homo sapiens
gtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatga

SEQ ID NO: 7661 - DNA, 805 bp, Homo sapiens
atcccttcaaggccactcagtccacagcattctctggtggcagacgctgcaggaggagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcct

SEQ ID NO: 7662 - DNA, 1545 bp, Homo sapiens
ttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaag

SEQ ID NO: 7663 - DNA, 2706 bp, Homo sapiens
ctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactata

SEQ ID NO: 7664 - DNA, 2807 bp, Homo sapiens
ggctcagatcccacgctgccattcggtagatatgtgtctttagataagtgacttaactttcccgaattttagagtcctcatctaaagattctaataccttcctgacagactgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactata

SEQ ID NO: 7665 - DNA, 500 bp, Homo sapiens
ggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctg

SEQ ID NO: 7666 - DNA, 2155 bp, Homo sapiens
gtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaa

SEQ ID NO: 7667 - DNA, 3264 bp, Homo sapiens
aaaagctcgggggcgggcttctgagttcgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagta

SEQ ID NO: 7668 - DNA, 2929 bp, Homo sapiens
cccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtaaatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagt

SEQ ID NO: 7669 - DNA, 4770 bp, Homo sapiens
gttaagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctaggttttgatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggt

SEQ ID NO: 7670 - DNA, 4791 bp, Homo sapiens
aagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaat

SEQ ID NO: 7671 - DNA, 2322 bp, Homo sapiens
cgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtc

SEQ ID NO: 7672 - DNA, 2311 bp, Homo sapiens
gttaagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaataccctcctcctcctccccctcctcctccttcacgtaaatgaaaccactcaagtggtagtgactccagcagacttaattacattttaa

SEQ ID NO: 7673 - DNA, 3629 bp, Homo sapiens
gagtagaagtgatttggcctcataacttcacagtggtttaccactttgttctatgttctggttttgtaaaggatagtactggaatttgcgtctgaagaccaatattggtgtaactcctgtcagtatattggtaaaatgtagcagaggcaggagtttggatgtttggatgggattcccttaggattctacagccaataaagatcctatttcctatgcatgtcccaggaatcagtaatcctcttttactctgttgggatgagtctttttttgtttctgttcagagtggttactaacttcaccttctttcctcttgctgtcatctgcattcgtgcttcccacctgttgttggcatgtcctttaccttctctttccctgccacatcaacctacacactgactcatcattgacgtggaagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggt

SEQ ID NO: 7674 - DNA, 3796 bp, Homo sapiens
ccagcgttcctgtgacgcgtttcctgttggccgagctgcgcacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgcgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggcattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 7675 - DNA, 3195 bp, Homo sapiens
aaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgcgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggcattttgtacataatctaatttttatatgcatgttcatgctttttaatttttttatcaaaaattaagtcatctacctactacttgtaaccagcttgtttcataacatgttattttcctgtgtcattaaataattacttcaatgttg

SEQ ID NO: 7676 - DNA, 4212 bp, Homo sapiens
gtgcgccagggacttgctaggagataaatggggtttatctcaccggagataaatgtggttgcacagcagatggacacaccagccaatgtggtaaataaacccttgggtccagctacgttctgcgcgctctctgccagcacagaggagcagcgagtcagggtacggagcgggtagcgttggggaagaggtggccgcgaagcgagacaggccagcggaacggaaaacggaagcacgagacgggggcgtgacgcaccgggcgcatcacaaagaacggcgagagggcggtggcgccgggggcacggctgggcggctccgcccagaagagggccgagaggcggggcggtgcccccaccgcaggcccgcggcgccctctgcaggccacaggcagcgactcaccagttgcctcatctttcctctcctccctcttggggctttcctcaggccacattttttgtgtgtctgggcagtctctcagcctccgactcccgtccctttcttccacttccaggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgttggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcagttgctgtcttacttgtgttgctcagatagaggagcagctcttaatcttttttggttcttggatccttttatgaatcagctgatagctatagattgacttcaggaaatttctcattccataagcacagaattgtgagtgtaatttcaaggggttcatagaccctctgaagttcatctatacagtccagattaacaagtgacctgctctgctggtaggctaggggaagttctagctcttagttttaagtattttgtggaagctggaattgattctcttcagacacttcttagtacatcctaattttgtgtcttctagaaaattttccccagtttttacctctaatgttaggatccaagaggagcttggatctgagctgatgcatctgtaaattacgatttagaaaaatataattggaaattacatattctttgctttttt

SEQ ID NO: 7677 - DNA, 1263 bp, Homo sapiens
ccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgttggggcgctgcgggctcgatttaattgttcaagctaaatctggcaccgggaaaacctgtgtgttctccaccatagctttggactctcttgttcttgaaaacttaagtacccaggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaa

SEQ ID NO: 7678 - DNA, 4711 bp, Homo sapiens
gggaagtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgatttta

SEQ ID NO: 7679 - DNA, 299 bp, Homo sapiens
ttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaagaaaaaaaaaaaaaaaaaa

SEQ ID NO: 7680 - DNA, 2832 bp, Homo sapiens
atctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctat

SEQ ID NO: 7681 - DNA, 567 bp, Homo sapiens
aaagatggcgacggctccgcgacgttgaggccgcgttgggcggttcagactcagggtgtagagatggggtttcaccgtgttggccaggatggtctcaatctcctgacctcatgatctgcccgctttggcctccaaaagtgctaggattacacgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaag

SEQ ID NO: 7682 - DNA, 696 bp, Homo sapiens
aaagatggcgacggctccgcgacgttgaggccgcgttgggcggttcagactcagggtgagatggggtttcaccgtgttggccaggatggtctcaatctcctgacctcatgatctgcccgctttggcctccaaaagtgctaggattacacgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaa

SEQ ID NO: 7683 - DNA, 2981 bp, Homo sapiens
agcgcgcacgagtacgtgcgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 7684 - DNA, 2738 bp, Homo sapiens
gtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaatt

SEQ ID NO: 7685 - DNA, 2610 bp, Homo sapiens
agttgctgctgcagctgaggtacagcggcggtttctgaggttcttcactcgcgactgacggagctgcggtggcgtctccacacgatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttct

SEQ ID NO: 7686 - DNA, 1730 bp, Homo sapiens
aaagagcagactggaaatctaaaacaggagttggatgacaaaagcgccatgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaac

SEQ ID NO: 7687 - DNA, 2592 bp, Homo sapiens
gagtagagagtgaaccttggcttaaaaggaaggaaaataactgtgaagaaaagatgacccaacttgaaataaaacctgaagaccttatctcccacttgagagagagaagaagctgaaagccatcagcttgcactctgggctcacagacagagagggtgaggggttgagcccagatctatgacttcagacccctgtctcggcccctaggcctgatcattcattcaaactctcaataaacacggattaccagaccctgcgcagggaacacatctgggaaaacagctgcaacctcggataccagcacgggacaagctatctcagggcaatgaggaacaactaaagagaatcccaggaaccaggtaaccaatcgccagaagccctccgccctcatggtccattgggtcaaggccccactgccgcctcgtatcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctaacgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcctcccctaagaataattagcaccggggcgg

SEQ ID NO: 7688 - DNA, 5334 bp, Homo sapiens
ctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtc

SEQ ID NO: 7689 - DNA, 1051 bp, Homo sapiens
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaa

SEQ ID NO: 7690 - DNA, 2349 bp, Homo sapiens
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcagtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgccttta

SEQ ID NO: 7691 - DNA, 1592 bp, Homo sapiens
gcatgcgcgaatcccgactgattagtgacctgggggggtttgcgggagtgcgcagcgcggcgggacgcgactggaggcccttttggcttggagggcttcggccttcacggctggcgcagcctggattcccgtccggaggacctggcggcacccggtgtttgcgtgcctgcgagcaagggtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaa

SEQ ID NO: 7692 - DNA, 4445 bp, Homo sapiens
gcgtaggctaaccagtgcgcttaatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 7693 - DNA, 2709 bp, Homo sapiens
agaggggtctggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaa

SEQ ID NO: 7694 - DNA, 792 bp, Homo sapiens
gaaggatggctgccgcgtgcttctcttgaccctgtagaaataatggaaattggacgcccgcggaaagacacctggaagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaag

SEQ ID NO: 7695 - DNA, 1049 bp, Homo sapiens
ggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacag

SEQ ID NO: 7696 - DNA, 2330 bp, Homo sapiens
gaaggaccggaaagggatggtggggagggtagggaaggatggctgccgcgtgcttctcttgaccctgtagaaataatggaaattggacgcccgcggaaagacacctggaagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactg

SEQ ID NO: 7697 - DNA, 1529 bp, Homo sapiens
agttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7698 - DNA, 2039 bp, Homo sapiens
cagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7699 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7700 - DNA, 1529 bp, Homo sapiens
agttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7701 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7702 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7703 - DNA, 591 bp, Homo sapiens
cattgtgttcgttttgctcccttcttccaatgggttcttctcatattggaggcctcagcatcaatgagaggcggtgctcggcgtcccttggtcttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 7704 - DNA, 2039 bp, Homo sapiens
cagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7705 - DNA, 720 bp, Homo sapiens
cgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttgg

SEQ ID NO: 7706 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7707 - DNA, 561 bp, Homo sapiens
actcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctaca

SEQ ID NO: 7708 - DNA, 720 bp, Homo sapiens; identical to SEQ ID NO: 7705

SEQ ID NO: 7709 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7710 - DNA, 1005 bp, Homo sapiens
ttggatttttctcaccttgacttgcccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 7711 - DNA, 2039 bp, Homo sapiens; identical to SEQ ID NO: 7698

SEQ ID NO: 7712 - DNA, 659 bp, Homo sapiens
cccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagac

SEQ ID NO: 7713 - DNA, 720 bp, Homo sapiens; identical to SEQ ID NO: 7705

SEQ ID NO: 7714 - DNA, 932 bp, Homo sapiens
cttcgctacaatccgtttccatctgcgcttctccgcacccatcccgtcacatgggttcctgatacccttttcacaggcgatggtctggtcgctggggcctagttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 7715 - DNA, 583 bp, Homo sapiens
acatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccat

SEQ ID NO: 7716 - DNA, 1433 bp, Homo sapiens
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaact

SEQ ID NO: 7717 - DNA, 914 bp, Homo sapiens
ttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 7718 - DNA, 583 bp, Homo sapiens
ttcgtcgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcaca

SEQ ID NO: 7719 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7720 - DNA, 633 bp, Homo sapiens
cgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccatatgtctccgtatacttcctgcctaaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 7721 - DNA, 566 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 7722 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7723 - DNA, 928 bp, Homo sapiens
ccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 7724 - DNA, 591 bp, Homo sapiens
cattgtgttcgttttgctcccttcttccaatgggttcttctcatattggaggcctcagcatcaatgagaggcggcgctcggcgtcccttggtcttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 7725 - DNA, 583 bp, Homo sapiens
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccat

SEQ ID NO: 7726 - DNA, 2178 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggtgtgtttttgtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7727 - DNA, 1005 bp, Homo sapiens; identical to SEQ ID NO: 7710

SEQ ID NO: 7728 - DNA, 561 bp, Homo sapiens; identical to SEQ ID NO: 7707

SEQ ID NO: 7729 - DNA, 583 bp, Homo sapiens; identical to SEQ ID NO: 7718

SEQ ID NO: 7730 - DNA, 583 bp, Homo sapiens
ttcgtcgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcaca

SEQ ID NO: 7731 - DNA, 583 bp, Homo sapiens; identical to SEQ ID NO: 7725

SEQ ID NO: 7732 - DNA, 928 bp, Homo sapiens
ccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 7733 - DNA, 720 bp, Homo sapiens
cgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttgg

SEQ ID NO: 7734 - DNA, 1201 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7735 - DNA, 928 bp, Homo sapiens; identical to SEQ ID NO: 7723

SEQ ID NO: 7736 - DNA, 561 bp, Homo sapiens; identical to SEQ ID NO: 7707

SEQ ID NO: 7737 - DNA, 720 bp, Homo sapiens; identical to SEQ ID NO: 7705

SEQ ID NO: 7738 - DNA, 659 bp, Homo sapiens; identical to SEQ ID NO: 7712

SEQ ID NO: 7739 - DNA, 720 bp, Homo sapiens; identical to SEQ ID NO: 7705

SEQ ID NO: 7740 - DNA, 1201 bp, Homo sapiens; identical to SEQ ID NO: 7734

SEQ ID NO: 7741 - DNA, 1005 bp, Homo sapiens
ttggatttttctcaccttgacttgcccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 7742 - DNA, 914 bp, Homo sapiens; identical to SEQ ID NO: 7717

SEQ ID NO: 7743 - DNA, 914 bp, Homo sapiens; identical to SEQ ID NO: 7717

SEQ ID NO: 7744 - DNA, 394 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 7745 - DNA, 406 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 7746 - DNA, 817 bp, Homo sapiens
accggaagtgaaggcagatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 7747 - DNA, 561 bp, Homo sapiens; identical to SEQ ID NO: 7707

SEQ ID NO: 7748 - DNA, 633 bp, Homo sapiens
cgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 7749 - DNA, 633 bp, Homo sapiens; identical to SEQ ID NO: 7748

SEQ ID NO: 7750 - DNA, 583 bp, Homo sapiens; identical to SEQ ID NO: 7718

SEQ ID NO: 7751 - DNA, 1529 bp, Homo sapiens; identical to SEQ ID NO: 7700

SEQ ID NO: 7752 - DNA, 2133 bp, Homo sapiens; identical to SEQ ID NO: 7699

SEQ ID NO: 7753 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7754 - DNA, 914 bp, Homo sapiens; identical to SEQ ID NO: 7717

SEQ ID NO: 7755 - DNA, 932 bp, Homo sapiens; identical to SEQ ID NO: 7714

SEQ ID NO: 7756 - DNA, 633 bp, Homo sapiens; identical to SEQ ID NO: 7720

SEQ ID NO: 7757 - DNA, 633 bp, Homo sapiens; identical to SEQ ID NO: 7720

SEQ ID NO: 7758 - DNA, 539 bp, Homo sapiens
gttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 7759 - DNA, 633 bp, Homo sapiens; identical to SEQ ID NO: 7720

SEQ ID NO: 7760 - DNA, 561 bp, Homo sapiens; identical to SEQ ID NO: 7707

SEQ ID NO: 7761 - DNA, 192 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 7762 - DNA, 75 bp, Homo sapiens
tggccacactgcaacagctggagccagttactgggcaggtgtctgtactggtgatgtgtcacactcgggagttgg

SEQ ID NO: 7763 - DNA, 63 bp, Homo sapiens
tggccacactgcaacagctggagccagttactgggcaggtgtctgtactggtgatgtgtcaca

SEQ ID NO: 7764 - DNA, 1005 bp, Homo sapiens; identical to SEQ ID NO: 7710

SEQ ID NO: 7765 - DNA, 928 bp, Homo sapiens; identical to SEQ ID NO: 7723

SEQ ID NO: 7766 - DNA, 928 bp, Homo sapiens; identical to SEQ ID NO: 7732

SEQ ID NO: 7767 - DNA, 1224 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7768 - DNA, 817 bp, Homo sapiens
accggaagtgaaggcagatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 7769 - DNA, 817 bp, Homo sapiens; identical to SEQ ID NO: 7768

SEQ ID NO: 7770 - DNA, 1005 bp, Homo sapiens
ttggatttttctcaccttgacttggccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 7771 - DNA, 1529 bp, Homo sapiens; identical to SEQ ID NO: 7700

SEQ ID NO: 7772 - DNA, 583 bp, Homo sapiens; identical to SEQ ID NO: 7718

SEQ ID NO: 7773 - DNA, 591 bp, Homo sapiens; identical to SEQ ID NO: 7703

SEQ ID NO: 7774 - DNA, 583 bp, Homo sapiens; identical to SEQ ID NO: 7725

SEQ ID NO: 7775 - DNA, 1005 bp, Homo sapiens; identical to SEQ ID NO: 7741

SEQ ID NO: 7776 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7777 - DNA, 591 bp, Homo sapiens; identical to SEQ ID NO: 7703

SEQ ID NO: 7778 - DNA, 659 bp, Homo sapiens; identical to SEQ ID NO: 7712

SEQ ID NO: 7779 - DNA, 591 bp, Homo sapiens; identical to SEQ ID NO: 7703

SEQ ID NO: 7780 - DNA, 633 bp, Homo sapiens; identical to SEQ ID NO: 7720

SEQ ID NO: 7781 - DNA, 659 bp, Homo sapiens; identical to SEQ ID NO: 7712

SEQ ID NO: 7782 - DNA, 932 bp, Homo sapiens
cttcgctacaatccgtttccatctgcgcttctccgcacccatcccgtcacatgggttcctgatacccttttcacaggcgatggtctggtcgctggggcctagttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 7783 - DNA, 932 bp, Homo sapiens; identical to SEQ ID NO: 7714

SEQ ID NO: 7784 - DNA, 817 bp, Homo sapiens; identical to SEQ ID NO: 7746

SEQ ID NO: 7785 - DNA, 2039 bp, Homo sapiens; identical to SEQ ID NO: 7698

SEQ ID NO: 7786 - DNA, 561 bp, Homo sapiens; identical to SEQ ID NO: 7707

SEQ ID NO: 7787 - DNA, 591 bp, Homo sapiens; identical to SEQ ID NO: 7703

SEQ ID NO: 7788 - DNA, 817 bp, Homo sapiens; identical to SEQ ID NO: 7768

SEQ ID NO: 7789 - DNA, 914 bp, Homo sapiens; identical to SEQ ID NO: 7717

SEQ ID NO: 7790 - DNA, 1529 bp, Homo sapiens; identical to SEQ ID NO: 7700

SEQ ID NO: 7791 - DNA, 928 bp, Homo sapiens; identical to SEQ ID NO: 7723

SEQ ID NO: 7792 - DNA, 914 bp, Homo sapiens; identical to SEQ ID NO: 7717

SEQ ID NO: 7793 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7794 - DNA, 583 bp, Homo sapiens; identical to SEQ ID NO: 7718

SEQ ID NO: 7795 - DNA, 1201 bp, Homo sapiens; identical to SEQ ID NO: 7734

SEQ ID NO: 7796 - DNA, 583 bp, Homo sapiens; identical to SEQ ID NO: 7725

SEQ ID NO: 7797 - DNA, 867 bp, Homo sapiens
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcagagccatgagcacatgacctctgttacccttgacaacctgacagctgtgggggatgttctgtcgcaagcgtggggttcatgatttagatcacataattgaagtcatttattatcggcccaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctc

SEQ ID NO: 7798 - DNA, 817 bp, Homo sapiens; identical to SEQ ID NO: 7768

SEQ ID NO: 7799 - DNA, 591 bp, Homo sapiens; identical to SEQ ID NO: 7724

SEQ ID NO: 7800 - DNA, 928 bp, Homo sapiens; identical to SEQ ID NO: 7723

SEQ ID NO: 7801 - DNA, 1529 bp, Homo sapiens; identical to SEQ ID NO: 7697

SEQ ID NO: 7802 - DNA, 932 bp, Homo sapiens; identical to SEQ ID NO: 7714

SEQ ID NO: 7803 - DNA, 96 bp, Homo sapiens
tggccacactgcaacagctggagccagttactgggcaggtgtgtttttgtgacagtcacttccctagaggggataatgaagagctacatttaccat

SEQ ID NO: 7804 - DNA, 583 bp, Homo sapiens; identical to SEQ ID NO: 7725

SEQ ID NO: 7805 - DNA, 583 bp, Homo sapiens; identical to SEQ ID NO: 7725

SEQ ID NO: 7806 - DNA, 914 bp, Homo sapiens; identical to SEQ ID NO: 7717

SEQ ID NO: 7807 - DNA, 932 bp, Homo sapiens; identical to SEQ ID NO: 7714

SEQ ID NO: 7808 - DNA, 1337 bp, Homo sapiens
ttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctccctttgggggagggcaggatttttctgccctaccacccacccatccatcgtctcttacatgcaccctacagccacgcaccctcaaggtggcatcgagcgtacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactcctt

SEQ ID NO: 7809 - DNA, 2133 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7810 - DNA, 1529 bp, Homo sapiens; identical to SEQ ID NO: 7700

SEQ ID NO: 7811 - DNA, 659 bp, Homo sapiens
cccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggcgctcggcgtcccttggtcttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagac

SEQ ID NO: 7812 - DNA, 583 bp, Homo sapiens; identical to SEQ ID NO: 7730

SEQ ID NO: 7813 - DNA, 561 bp, Homo sapiens; identical to SEQ ID NO: 7707

SEQ ID NO: 7814 - DNA, 817 bp, Homo sapiens
accggaagtgaaggcacatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 7815 - DNA, 413 bp, Homo sapiens
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 7816 - DNA, 1005 bp, Homo sapiens; identical to SEQ ID NO: 7710

SEQ ID NO: 7817 - DNA, 2003 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 7818 - DNA, 932 bp, Homo sapiens; identical to SEQ ID NO: 7782

SEQ ID NO: 7819 - DNA, 2039 bp, Homo sapiens; identical to SEQ ID NO: 7698

SEQ ID NO: 7820 - DNA, 720 bp, Homo sapiens; identical to SEQ ID NO: 7733

SEQ ID NO: 7821 - DNA, 290 bp, Homo sapiens
tggccacactgcaacagctggagccagttactgggcaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 7822 - DNA, 659 bp, Homo sapiens; identical to SEQ ID NO: 7712

SEQ ID NO: 7823 - DNA, 659 bp, Homo sapiens; identical to SEQ ID NO: 7811

SEQ ID NO: 7824 - DNA, 2003 bp, Homo sapiens; identical to SEQ ID NO: 7753

SEQ ID NO: 7825 - DNA, 1337 bp, Homo sapiens
ttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctcccttcgggggagggcaggatttttctgccctaccacccacccatccatcgtctcttacatgcaccctacagccacgcaccctcaaggtggcatcgagcatacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactcctt

SEQ ID NO: 7826 - DNA, 1603 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggaaatcacatgtaagtctgtgcagcgattttcaacgacgaattcttgtggctaccaacctatttggccgaggcatggacatcgagcgggtgaacattgcttttaa

SEQ ID NO: 7827 - DNA, 1603 bp, Homo sapiens
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggaaatcacatgtaagtctgtgcagcgattttcaacgacgaattcttgtggctaccaacctatttggccgaggcatggacatcgagcgggtgaacattgcttttaa

SEQ ID NO: 7828 - DNA, 1571 bp, Homo sapiens
cgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggtgtgtttttgtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatcta

SEQ ID NO: 7829 - DNA, 1337 bp, Homo sapiens; identical to SEQ ID NO: 7808

SEQ ID NO: 7830 - DNA, 1552 bp, Homo sapiens
cgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggtgtgtttttgtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaact

SEQ ID NO: 7831 - DNA, 867 bp, Homo sapiens; identical to SEQ ID NO: 7797

SEQ ID NO: 7832 - DNA, 1337 bp, Homo sapiens; identical to SEQ ID NO: 7825

SEQ ID NO: 7833 - DNA, 1337 bp, Homo sapiens; identical to SEQ ID NO: 7825

SEQ ID NO: 7834 - DNA, 867 bp, Homo sapiens
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcagagccatgagcacatgacctctgttacccttgacaacctgacagctgtgggggatgttctgtcgcaagcgtggggttcatgatttagatcacagaattgaagtcatttattatcggcccaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctc
